US011685780B2

(12) United States Patent
May et al.

(10) Patent No.: US 11,685,780 B2
(45) Date of Patent: Jun. 27, 2023

(54) SINGLE DOMAIN ANTIGEN BINDING DOMAINS THAT BIND HUMAN TROP2

(71) Applicant: TAKEDA PHARMACEUTICAL COMPANY LIMITED, Osaka (JP)

(72) Inventors: Chad May, Belmont, CA (US); Robert B. Dubridge, Belmont, CA (US); Maia Vinogradova, Moraga, CA (US); Anand Panchal, San Francisco, CA (US)

(73) Assignee: Takeda Pharmaceutical Company Limited, Osaka (JP)

( * ) Notice: Subject to any disclaimer, the term of this patent is extended or adjusted under 35 U.S.C. 154(b) by 144 days.

(21) Appl. No.: 16/810,770

(22) Filed: Mar. 5, 2020

(65) Prior Publication Data

US 2020/0347132 A1 Nov. 5, 2020

Related U.S. Application Data

(60) Provisional application No. 62/814,210, filed on Mar. 5, 2019, provisional application No. 62/814,744, filed on Mar. 6, 2019, provisional application No. 62/826,523, filed on Mar. 29, 2019.

(51) Int. Cl.
*A61K 39/00* (2006.01)
*C07K 16/28* (2006.01)
*A61P 35/00* (2006.01)

(52) U.S. Cl.
CPC .......... *C07K 16/2806* (2013.01); *A61P 35/00* (2018.01); *A61K 2039/505* (2013.01); *C07K 2317/569* (2013.01); *C07K 2317/94* (2013.01); *C07K 2319/30* (2013.01)

(58) Field of Classification Search
CPC .................. C07K 2319/50; C07K 2317/31
See application file for complete search history.

(56) References Cited

U.S. PATENT DOCUMENTS

| | | | |
|---|---|---|---|
| 4,816,567 A | 3/1989 | Cabilly et al. | |
| 5,648,237 A | 7/1997 | Carter | |
| 5,731,168 A | 3/1998 | Carter et al. | |
| 5,789,199 A | 8/1998 | Joly et al. | |
| 5,840,523 A | 11/1998 | Simmons et al. | |
| 5,959,177 A | 9/1999 | Hein et al. | |
| 6,040,498 A | 3/2000 | Stomp | |
| 6,417,429 B1 | 7/2002 | Hein et al. | |
| 6,420,548 B1 | 7/2002 | Vezina et al. | |
| 7,125,978 B1 | 10/2006 | Vezina et al. | |
| 7,186,076 B2 | 3/2007 | Doring et al. | |
| 8,513,390 B2 | 8/2013 | Stagliano et al. | |
| 8,563,269 B2 | 10/2013 | Stagliano et al. | |
| 9,120,853 B2 | 9/2015 | Lowman et al. | |
| 9,517,276 B2 | 12/2016 | Lowman et al. | |
| 9,688,748 B2 | 6/2017 | West et al. | |
| 9,708,412 B2 | 7/2017 | Baeuerle et al. | |
| 9,775,913 B2 | 10/2017 | Lauermann | |
| 9,920,115 B2 | 3/2018 | DuBridge et al. | |
| 10,035,856 B2 | 7/2018 | Cobbold | |
| 10,066,016 B2 | 9/2018 | DuBridge et al. | |
| 10,301,380 B2 | 5/2019 | West et al. | |
| 11,406,710 B2 | 8/2022 | May et al. | |
| 2007/0123479 A1 | 5/2007 | Kufer et al. | |
| 2007/0269422 A1 | 11/2007 | Beirnaer et al. | |
| 2008/0044413 A1 | 2/2008 | Hammond et al. | |
| 2009/0252681 A1 | 10/2009 | Laeremans et al. | |
| 2010/0003253 A1 | 1/2010 | Laeremans et al. | |
| 2011/0229476 A1 | 9/2011 | Liu et al. | |
| 2013/0224205 A1 | 8/2013 | Hofmeister et al. | |
| 2013/0266568 A1 | 10/2013 | Brinkmann et al. | |
| 2014/0004121 A1 | 1/2014 | Fanslow et al. | |
| 2014/0099318 A1 | 4/2014 | Huang et al. | |
| 2015/0079088 A1 | 3/2015 | Lowman et al. | |
| 2015/0079093 A1 | 3/2015 | Stuhler | |
| 2015/0183875 A1 | 7/2015 | Cobbold et al. | |
| 2015/0307629 A1 | 10/2015 | Bernett et al. | |
| 2016/0194399 A1 | 7/2016 | Irving et al. | |
| 2017/0247476 A1 | 8/2017 | Yan et al. | |
| 2017/0369563 A1 | 12/2017 | DuBridge et al. | |
| 2017/0369575 A1 | 12/2017 | DuBridge et al. | |
| 2018/0134789 A1 | 5/2018 | Baeuerle et al. | |
| 2019/0010242 A1 | 1/2019 | Eckelman et al. | |
| 2019/0076524 A1 | 3/2019 | May et al. | |
| 2019/0225702 A1 | 7/2019 | Baeuerle et al. | |
| 2020/0347132 A1 | 11/2020 | May et al. | |
| 2021/0238291 A1 | 8/2021 | Lowman et al. | |

(Continued)

FOREIGN PATENT DOCUMENTS

| | | |
|---|---|---|
| CA | 2912389 C | 1/2020 |
| CN | 108289952 | 7/2018 |
| CO | 6470824 | 6/2012 |

(Continued)

OTHER PUBLICATIONS

Akbar et al. Cell Reports. 34: 108856 (2021).
Ali et al., Hum Mol Genet 5:591 594, (1996).
Ali et al., Hum Gene Ther 9:81 86, (1998).
Anderson et al., Proc Natl Acad Sci USA 101 (2):7566-71 (2004).
Atwell et al., J Mol Biol, 270(1):26-35 (1997).
Bennett et al., Invest Opthalmol Vis Sci 38:2857 2863, (1997).
Borras et al., Gene Ther 6:515 524, (1999).
Bruhl, Immunol., 166, 2420-2426 (2001).
Carter et al., Proc. Natl. Acad. Sci. U.S.A. 89:4285-9 (1992).

(Continued)

*Primary Examiner* — Elly-Gerald Stoica
(74) *Attorney, Agent, or Firm* — Wolf, Greenfield & Sacks, P.C.

(57) ABSTRACT

The invention relates to COnditional Bispecific Redirected Activation constructs, or COBRAs, that are administered in an active pro-drug format. Upon exposure to tumor proteases, the constructs are cleaved and activated, such that they can bind both tumor target antigens (TTAs) as well as CD3, thus recruiting T cells expressing CD3 to the tumor, resulting in treatment. In some embodiments, the tumor target antigen is B7H3.

20 Claims, 182 Drawing Sheets

Specification includes a Sequence Listing.

(56) References Cited

U.S. PATENT DOCUMENTS

| | | |
|---|---|---|
| 2021/0309756 A1 | 10/2021 | DuBridge et al. |
| 2022/0144949 A1 | 5/2022 | DuBridge et al. |
| 2022/0273794 A1 | 9/2022 | May et al. |
| 2022/0273795 A1 | 9/2022 | May et al. |

FOREIGN PATENT DOCUMENTS

| | | |
|---|---|---|
| DE | 0060045668 | 7/2011 |
| JP | 2009-511032 A | 3/2009 |
| JP | 2013-538204 A | 10/2013 |
| JP | 2013-541939 A | 11/2013 |
| JP | 2014-129374 A | 7/2014 |
| JP | 2014-522641 A | 9/2014 |
| JP | 2015-509368 A | 3/2015 |
| JP | 2015-509951 A | 4/2015 |
| JP | 2015-509952 A | 4/2015 |
| JP | 2019-513014 A | 5/2019 |
| RU | 2401843 | 12/2007 |
| WO | WO 1993/009239 | 5/1993 |
| WO | WO 1993/019191 | 9/1993 |
| WO | WO 1994/012649 | 6/1994 |
| WO | WO 1994/028938 | 12/1994 |
| WO | WO 1995/011984 | 5/1995 |
| WO | WO 1999/054440 | 10/1999 |
| WO | WO 2004/021861 | 3/2004 |
| WO | WO 2007/042289 | 4/2007 |
| WO | WO 2008/119567 | 10/2008 |
| WO | WO 2008/119567 A2 | 10/2008 |
| WO | WO 2010/081173 | 7/2010 |
| WO | WO 2010/127284 | 11/2010 |
| WO | WO 2011/033105 | 3/2011 |
| WO | WO 2011/144749 | 11/2011 |
| WO | WO 2012/025525 | 3/2012 |
| WO | WO 2012/028716 | 3/2012 |
| WO | WO 2012/158818 | 11/2012 |
| WO | WO 2013/004607 | 1/2013 |
| WO | WO 2013/128027 | 3/2013 |
| WO | WO 2013/083809 | 6/2013 |
| WO | WO 2013/128194 | 9/2013 |
| WO | WO 2013/130381 | 9/2013 |
| WO | WO 2016/016859 A1 | 2/2016 |
| WO | WO 2016/033225 | 3/2016 |
| WO | WO 2016/033331 | 3/2016 |
| WO | WO 2016/046778 | 3/2016 |
| WO | WO 2016/046778 A2 | 3/2016 |
| WO | WO 2016/156570 | 10/2016 |
| WO | WO 2016/179003 | 11/2016 |
| WO | WO 2016/179285 | 11/2016 |
| WO | WO 2016/180969 | 11/2016 |
| WO | WO 2016/187594 | 11/2016 |
| WO | WO 2017/087789 | 5/2017 |
| WO | WO 2017/156178 | 9/2017 |
| WO | WO 2018/160671 | 9/2018 |
| WO | WO 2018/160754 | 9/2018 |
| WO | WO 2019/051102 | 3/2019 |
| WO | WO 2019/051122 | 3/2019 |
| WO | WO 2019/222278 | 11/2019 |
| WO | WO 2019/222282 | 11/2019 |
| WO | WO 2019/222283 | 11/2019 |
| WO | WO 2020/028444 A1 | 2/2020 |
| WO | WO 2020/033837 | 2/2020 |
| WO | WO 2020/061482 | 3/2020 |
| WO | WO 2020/131697 | 6/2020 |
| WO | WO 2020/132574 | 6/2020 |
| WO | WO 2020/181140 | 9/2020 |
| WO | WO 2020/181145 | 9/2020 |
| WO | WO 2020/223108 | 11/2020 |

OTHER PUBLICATIONS

Carter, J. Immunological Methods, 24(1-2):7-15 (2001).
Charbol et al., VHH characterization.Recombinant VHHs: Production, characterization and affinity. Analytical Biochemistry, Academic Press Amsterdam, NL vol. 589 (2019).
Chen et al. Adv Drug Deliv Rev. 65(10): 1357-1369 (2013).
Cheng M. et al., International Journal of Cancer, V. 136, N. 2, p. 476-486 (2015).
Chin et al., Science 301(5635):964-7 (2003).
Cropp & Shultz, Trends Genet. 20(12):625-30 (2004).
Donaldson et al., Cancer Biol Ther., 8(22): 2147-2152 (2009).
Ferrari et al., Journal of Experimental & Clinical Cancer Research, vol. 34, No. 1 (2015).
Flannery et al., PNAS 94:6916 6921 (1997).
Flotte et al., PNAS 90:10613-10617) (1993).
Fossati et al., Gynecologic Oncology, vol. 138, No. 2 (2015).
Frankel and Baeuerle, Current Opinion in Chemical Biology, vol. 17, No. 3 (2013).
Haas et al., Immunobiology, 214, pp. 441-453 (2009).
Huston et al., Proc. Natl. Acad. Sci USA 85:5879-5883 (1988).
Igawa et al., Protein Engineering Design & Selection, vol. 23, No. 8, pp. 667-677 (2010).
Jomary et al., Gene Ther 4:683 690, (1997).
Jones et al., Nature 321:522-525 (1986).
Kipriyanov, J. Mol. Biol., 293, 41-56 (1999).
Kufer, Cancer Immunol. Immunother., 45, 193-197 (1997).
Kufer P. et al., Trends in Biotechnology 22(5):238-244 (2004).
LaPorte et al. (AACR abstract, meeting held Nov. 5-9, 2015).
Li et al., Invest Opthalmol Vis Sci 35:2543 2549, (1994).
Li and Davidson, PNAS 92:7700 7704, (1995).
Liu et al., Bp—Bs, a Novel T-cell Engaging Bispecific Antibody with Biparatopic Her2 Binding, Has Potent Anti-tumor Activities. Molecular Therapy—Oncolytics, vol. 14 (2019).
Lo et al., BMC Genomics. 22(Suppl 2): 116 (2021).
Loffler, Blood, 95, 6, 2098-2103 (2000).
Mack, J. Immunol., 158, 3965-3970 (1997).
Mack, PNAS, 92, 7021-7025 (1995).
Marks and Deane, J. Biol. Chem., 295(29) 9823-9837 (2020).
May et al., Biochemical Pharmacology, vol. 84, No. 9 (2012).
Mendelson et al., Virol. 166:154-165 (1988).
Merchant et al., Nat Biotechnol, 16:677-681 (1998).
Miyoshi et al., PNAS 94:10319 23, (1997).
O'Connor et al., Protein Eng. 11:321-8 (1998).
Panchal et al., COBRA™ : a highly potent conditionally active T cell engager engineered for the treatment of solid tumors. MABS, vol. 12, No. 1 (2020).
Presta, Curr. Op. Struct. Biol. 2:593-596 (1992).
Queen et al., Proc. Natl. Acad. Sci., U.S.A. 86:10029-33 (1989).
Ridgway et al., Protein Engineering, vol. 9, No. 7, pp. 617-621 (1996).
Riechmann et al., Nature 332:323-329 (1988).
Rolling et al., Hum Gene Ther 10:641 648, (1999).
Sakamoto et al., Gene Ther 5:1088 1097 (1998).
Samulski et al., J. Vir. 63:3822-3828 (1989).
Science AAAS Webinar Series "New horizons in therapeutic antibody: Challenges and opportunities for improvement" (Jun. 17, 2020; pp. 1-3).
Shen et al., The Journal of Biological Chemistry, vol. 281, No. 16, pp. 10706-10714 (2006).
Simon et al., PNAS USA 89(20):9367 (1992).
Songsivilai & Lachmann, Clin. Exp. Immunol. 79:315-321 (1990).
Strohl, W. R., Fusion Proteins for Half-Life Extension of Biologies as a Strategy to Make Biobetters. BioDrugs, vol. 29, No. 4, pp. 215-239 (2015).
Takahashi et al., J Virol 73:7812 7816, (1999).
Torres and Casadevall, The immunoglobulin constant region contributes to affinity and specificity, Cell Press, pp. 91-97 (2007).
Vajda et al., Current Opinion in Structural Biology. 67:226-231 (2021).
Verhoeyen et al., Science, 239:1534-1536 (1988).
Weidle, U. H. et al., Proteases as activators for cytotoxic prodrugs in antitumor therapy. Cancer Genomics Proteomics, vol. 11, No. 2, pp. 67-79 (2014).
Xing et al., BiHC, a T-Cell-Engaging Bispecific Recombinant Antibody, Has Potent Cytotoxic Activity Against Her2 Tumor Cells. Translational Oncology. vol. 10, No. 5 (2017).

(56) References Cited

OTHER PUBLICATIONS

Xu et al., Production of bispecific antibodies in "knobs-into-holes" using a cell-free expression system. mAbs 7:1, 231-242; (2015).
U.S. Appl. No. 17/743,961, filed May 13, 2022, May et al.
U.S. Appl. No. 17/743,995, filed May 13, 2022, May et al.
U.S. Appl. No. 15/727,423, filed Oct. 6, 2017, Baeuerle et al.
U.S. Appl. No. 17/435,931, filed Sep. 2, 2021, DuBridge et al.
PCT/US2020/021270, Jun. 24, 2020, Invitation to Pay Additional Fees.
PCT/US2020/021270, Aug. 14, 2020, International Search Report and Written Opinion.
PCT/US2020/021270, filed Sep. 16, 2021, International Preliminary Report on Patentability.
Bluemel et al., Epitope distance to the target cell membrane and antigen size determine the potency of T cell-mediated lysis by BiTE antibodies specific for a large melanoma surface antigen. Cancer Immunol Immunother. Aug. 2010;59(8):1197-209. doi: 10.1007/s00262-010-0844-y. Epub Mar. 23, 2010.
Correnti et al., Simultaneous multiple interaction T-cell engaging (SMITE) bispecific antibodies overcome bispecific T-cell engager (BiTE) resistance via CD28 co-stimulation. Leukemia. May 2018;32(5):1239-1243. doi: 10.1038/s41375-018-0014-3. Epub Jan. 31, 2018.
Correnti et al., Simultaneous multiple interaction T-cell engaging (SMITE) bispecific antibodies overcome bispecific T-cell engager (BiTE) resistance via CD28 co-stimulation. Leukemia. May 2018. Supplemental Materials. 7 pages.
Dickopf et al., Format and geometries matter: Structure-based design defines the functionality of bispecific antibodies. Comput Struct Biotechnol J. May 14, 2020;18:1221-1227. doi: 10.1016/j.csbj.2020.05.006. eCollection 2020.
Igawa et al., VH/VL interface engineering to promote selective expression and inhibit conformational isomerization of thrombopoietin receptor agonist single-chain diabody. Protein Eng Des Sel. Aug. 2010;23(8):667-77. doi: 10.1093/protein/gzq034. Epub Jun. 24, 2010.
Roda-Navarro et al., Understanding the Spatial Topology of Artificial Immunological Synapses Assembled in T Cell-Redirecting Strategies: A Major Issue in Cancer Immunotherapy. Front Cell Dev Biol. Jan. 10, 2020;7:370. doi: 10.3389/fcell.2019.00370. eCollection 2019.
Rossini et al., Combined targeting of EGFR and HER2 against prostate cancer stem cells. Cancer Biol Ther. May 3, 2020;21(5):463-475. doi: 10.1080/15384047.2020.1727702. Epub Feb. 23, 2020.
Official Action issued in corresponding RU Application No. 2018134949 dated Aug. 31, 2022 citing DE 0060045668 (Translation of Official Action provided).
Fan et al. "Bispecific Antibodies and Their Applications." Journal of Hematology and Oncology, vol. 8, No. 130 (2015).
Giffin, M. et al., Clinical Cancer Research, vol. 27, No. 5 (2021).
Hipp, S. et al., Clinical Cancer Research, vol. 26, No. 19 (2020).

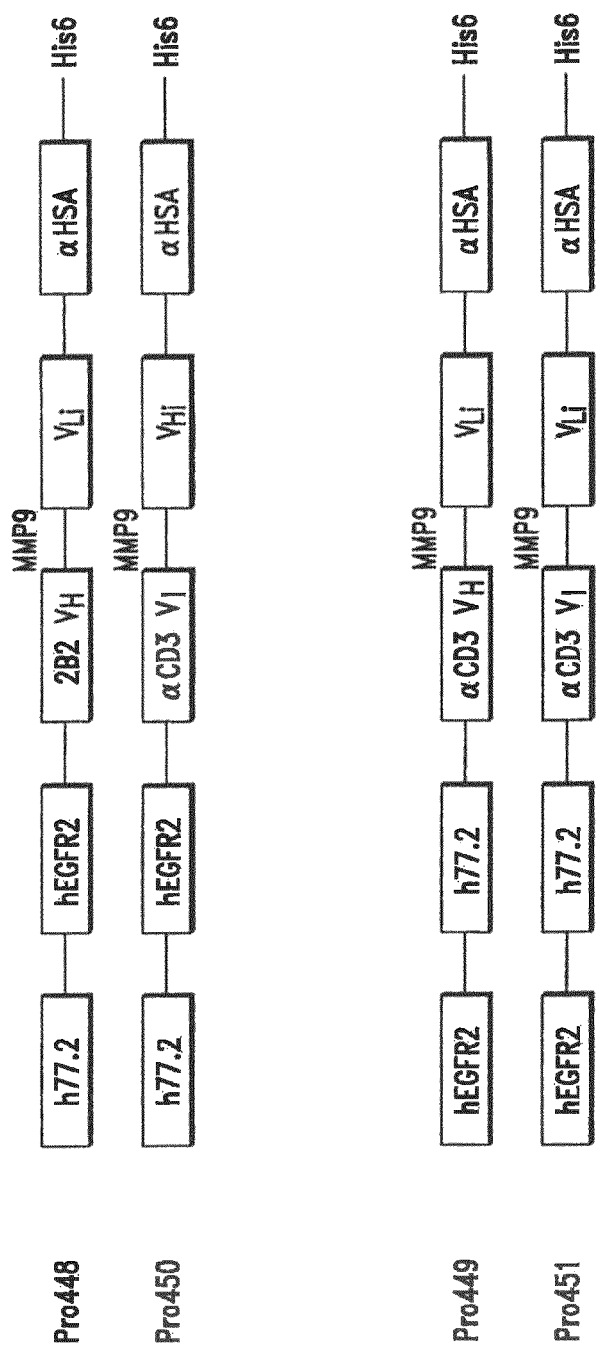

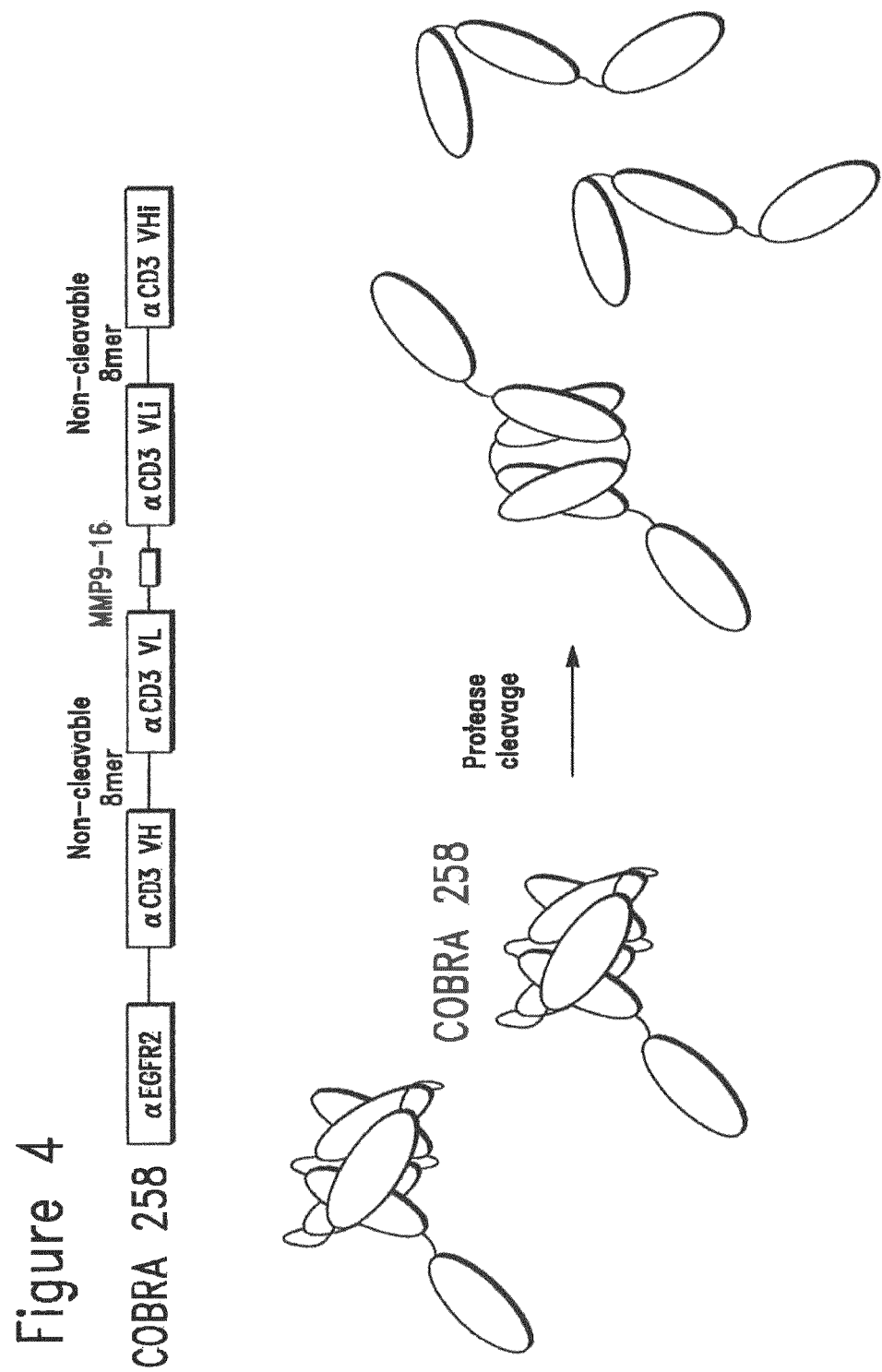

Figure 5A

αEGFR1

EVQLVESGGGLVQAGGSLRLSCAAS<u>GRTFSSYAMG</u>WFRQAPGKEREFVVA<u>INWS
SGSTYYADSVKG</u>RFTISRDNAKNTMYLQMNSLKPEDTAVYYCAA<u>GYQINSGNYNF
KDYEYDY</u>WGQGTQVTVSS (SEQ ID NO:1)

sdCDR1  <u>GRTFSSYAMG</u> (SEQ ID NO:2)
sdCDR2  <u>INWSSGSTYYADSVKG</u> (SEQ ID NO:3)
sdCDR3  <u>GYQINSGNYNFKDYEYDY</u> (SEQ ID NO:4)

αEGFR2

QVKLEESGGGSVQTGGSLRLTCAAS<u>GRTSRSYGMG</u>WFRQAPGKEREFVS<u>GISWR
GDSTGYADSVKG</u>RFTISRDNAKNTVDLQMNSLKPEDTAIYYCAA<u>AAGSAWYGTLY
EYDY</u>WGQGTQVTVSS (SEQ ID NO:5)

sdCDR1  <u>GRTSRSYGMG</u> (SEQ ID NO:6)
sdCDR2  <u>GISWRGDSTGYADSVKG</u> (SEQ ID NO:7)
sdCDR3  <u>AAGSAWYGTLYEYDY</u> (SEQ ID NO:8)

hαEGFR1

EVQLVESGGGLVQPGGSLRLSCAAS<u>GRTFSSYAMG</u>WFRQAPGKEREFVVA<u>INWS
SGSTYYADSVKG</u>RFTISRDNSKNTLYLQMNSLRAEDTAVYYCAA<u>GYQINSGNYNF
KDYEYDY</u>WGQGTLVTVSS (SEQ ID NO:9)

sdCDR1  <u>GRTFSSYAMG</u> (SEQ ID NO:10)
sdCDR2  <u>INWSSGSTYYADSVKG</u> (SEQ ID NO:11)
sdCDR3  <u>GYQINSGNYNFKDYEYDY</u> (SEQ ID NO:12)

aEGFR2a sdAb

EVQLVESGGGVVRPGGSLRLSCAAS<u>GRTSRSYGMG</u>WFRQAPGKEREFVS<u>GISW
RGDSTGYADSVKG</u>RFTISRDNAKNSLYLQMNSLRAEDTALYYCAA<u>AAGSAWYGTL
YEYDY</u>WGQGTLVTVSS (SEQ ID NO:13)

sdCDR1  <u>GRTSRSYGMG</u> (SEQ ID NO:14)
sdCDR2  <u>GISWRGDSTGYADSVKG</u> (SEQ ID NO:15)
sdCDR3  <u>AAGSAWYGTLYEYDY</u> (SEQ ID NO:16)

hαEGFR2d

QVKLVESGGGVVRPGGSLTLSCAAS<u>GRTSRSYGMG</u>WFRQAPGKEREFVS<u>GISWR
GDSTGYADSVKG</u>RFTISRDNAKNSLYLQMNSLRAEDTALYYCAA<u>AAGSAWYGTLY
EYDY</u>WGQGTLVTVSS (SEQ ID NO:17)

sdCDR1  <u>GRTSRSYGMG</u> (SEQ ID NO:18)
sdCDR2  <u>GISWRGDSTGYADSVKG</u> (SEQ ID NO:19)
sdCDR3  <u>AAGSAWYGTLYEYDY</u> (SEQ ID NO:20)

Figure 5B

αFOLR1 h77-2

QVQLVESGGGLVQPGGSLRLSCAAS<u>GFTVSNSVMA</u>WYRQTPGNEREFVAI<u>INSIGI
TNYADSVKG</u>RFTISRDNSKNTLYLQMNSLRAEDTAVYVCNR<u>NFDRIY</u>WGQGTLVT
VSS (SEQ ID NO:21)

sdCDR1 <u>GFTVSNSVMA</u> (SEQ ID NO:22)
sdCDR2 <u>IINSIGITNYADSVKG</u> (SEQ ID NO:23)
sdCDR3 <u>NFDRIY</u> (SEQ ID NO:24)

αFOLR1 h59.3

QVQLVESGGGLVQPGGSLRLSCAAP<u>GNTFSISAMG</u>WYRQAPGKQREWVA<u>VTHS
DYSTNYADSVKG</u>RFTISRDNSKNTLYLQMNSLRAEDTAVYYCKH<u>YGIDY</u>WGQGTL
VTVSS (SEQ ID NO:25)

sdCDR1 <u>GNTFSISAMG</u> (SEQ ID NO:26)
sdCDR2 <u>VTHSDYSTNYADSVKG</u> (SEQ ID NO:27)
sdCDR3 <u>YGIDY</u> (SEQ ID NO:28)

αFOLR1 h22-4

QVQLVESGGGLVQPGGSLRLSCEAS<u>GTTFSRDVMG</u>WYRQAPGKQRELVAI<u>ISRG
GSTNYADSVKG</u>RFTISRDNSKNTLYLQMNSLRAEDTAVYYC<u>NANTATWGRVF</u>WG
QGTLVTVSS (SEQ ID NO:29)

sdCDR1 <u>GTTFSRDVMG</u> (SEQ ID NO:30)
sdCDR2 <u>IISRGGSTNYADSVKG</u> (SEQ ID NO:31)
sdCDR3 <u>NTATWGRVF</u> (SEQ ID NO:32)

αB7H3 hF7

QVQLQESGGGLVQPGGSLRLSCAPS<u>RRTFHTYHMG</u>WFRQAPGKEREFVA<u>VINWS
GGSTVYADSVKG</u>RFTISRDNSKNTLYLQMNSLRAEDTA<u>VYYCAAGGATTQRATEA
SYDY</u>WGQGTLVTVSS (SEQ ID NO:33)

sdCDR1 <u>RRTFHTYHMG</u> (SEQ ID NO:34)
sdCDR2 <u>VINWSGGSTVYADSVKG</u> (SEQ ID NO:35)
sdCDR3 <u>GGATTQRATEASYDY</u> (SEQ ID NO:36)

QVQLQESGGGLVQPGGSLRLSCEAS<u>PRTFSTYSMA</u>WFRQAPGKERSFVA<u>AINWSGGNTSYADSVKG</u>RFTISRDNSKNTLYLQMNSLRAEDTAVYYCAA<u>GGVLAHHNYEYDY</u>WGQGTLVTVSS (SEQ ID NO:37)

sdCDR1 <u>PRTFSTYSMA</u> (SEQ ID NO:38)
sdCDR2 <u>AINWSGGNTSYADSVKG</u> (SEQ ID NO:39)
sdCDR3 <u>GGVLAHHNYEYDY</u> (SEQ ID NO:40)

αB7H3 hF12 (N57Q)

QVQLQESGGGLVQPGGSLRLSCEAS<u>PRTFSTYSMA</u>WFRQAPGKERSFVA<u>AINWSGGQTSYADSVKG</u>RFTISRDNSKNTLYLQMNSLRAEDTAVYYCAA<u>GGVLAHHNYEYDY</u>WGQGTLVTVSS (SEQ ID NO:41)

sdCDR1 <u>PRTFSTYSMA</u> (SEQ ID NO:42)
sdCDR2 <u>AINWSGGQTSYADSVKG</u> (SEQ ID NO:43)
sdCDR3 <u>GGVLAHHNYEYDY</u> (SEQ ID NO:44)

αB7H3 hF12 (N57E)

QVQLQESGGGLVQPGGSLRLSCEAS<u>PRTFSTYSMA</u>WFRQAPGKERSFVA<u>AINWSGGETSYADSVKG</u>RFTISRDNSKNTLYLQMNSLRAEDTAVYYCAA<u>GGVLAHHNYEYDY</u>WGQGTLVTVSS (SEQ ID NO:45)

sdCDR1 <u>PRTFSTYSMA</u> (SEQ ID NO:46)
sdCDR2 <u>AINWSGGETSYADSVKG</u> (SEQ ID NO:47)
sdCDR3 <u>GGVLAHHNYEYDY</u> (SEQ ID NO:48)

αB7H3 hF12 (N57D)

QVQLQESGGGLVQPGGSLRLSCEAS<u>PRTFSTYSMA</u>WFRQAPGKERSFVA<u>AINWSGGDTSYADSVKG</u>RFTISRDNSKNTLYLQMNSLRAEDTAVYYCAA<u>GGVLAHHNYEYDY</u>WGQGTLVTVSS (SEQ ID NO:49)

sdCDR1 <u>PRTFSTYSMA</u> (SEQ ID NO:50)
sdCDR2 <u>AINWSGGDTSYADSVKG</u> (SEQ ID NO:51)
sdCDR3 <u>GGVLAHHNYEYDY</u> (SEQ ID NO:52)

QVQLQESGGGLVQPGGSLRLSCEAS<u>PRTFSTYSMA</u>WFRQAPGKERSFVA<u>**AINWS
GGNTAYADSVKG</u>RFTISRDNSKNTLYLQMNSLRAEDTA<u>VYYCAAGGVLAHHNYEY
DY**</u>WGQGTLVTVSS (SEQ ID NO:53)

sdCDR1 <u>PRTFSTYSMA</u> (SEQ ID NO:54)
sdCDR2 <u>AINWSGGNTAYADSVKG</u> (SEQ ID NO:55)
sdCDR3 <u>GGVLAHHNYEYDY</u> (SEQ ID NO:56)

<u>αB7H3 hF12 (S59Y)</u>

QVQLQESGGGLVQPGGSLRLSCEAS<u>PRTFSTYSMA</u>WFRQAPGKERSFVA<u>**AINWS
GGNTYYADSVKG</u>RFTISRDNSKNTLYLQMNSLRAEDTA<u>VYYCAAGGVLAHHNYEY
DY**</u>WGQGTLVTVSS (SEQ ID NO:57)

sdCDR1 <u>PRTFSTYSMA</u> (SEQ ID NO:58)
sdCDR2 <u>AINWSGGNTYYADSVKG</u> (SEQ ID NO:59)
sdCDR3 <u>GGVLAHHNYEYDY</u> (SEQ ID NO:60)

<u>αEpCAM h13</u>

QVQLVESGGGLVQPGGSLTLSCAAS<u>GTGSIFSINLMG</u>WYRQAPGKQRELVA<u>**RITS
GDSTVYADSVKG</u>RFTISRDNSKNTLYLQMNSLRPEDTAVYYCNL<u>LLRSSPGATTPY**</u>
WGQGTLVTVSS (SEQ ID NO:61)

sdCDR1 <u>GTGSIFSINLMG</u> (SEQ ID NO:62)
sdCDR2 <u>RITSGDSTVYADSVKG</u> (SEQ ID NO:63)
sdCDR3 <u>LLRSSPGATTPY</u> (SEQ ID NO:64)

<u>αEpCAM h23</u>

QVQLVESGGGLVQPGGSLTLSCVIS<u>GSFSALWAMR</u>WYRQAPGQQRELVA<u>**SSRG
GTTSYADSVKG</u>RFTISRDNSKNTLYLQMNSLRPEDTAVYYCNA<u>IDGHLAY**</u>WGQGT
LVTVSS (SEQ ID NO:65)

sdCDR1 <u>GSFSALWAMR</u> (SEQ ID NO:66)
sdCDR2 <u>SSRGGTTSYADSVKG</u> (SEQ ID NO:67)
sdCDR3 <u>IDGHLAY</u> (SEQ ID NO:68)

Figure 5E acEpCAM hVIB665

QVQLLESGGGLVQPGGSLRLSCAAS<u>GRTFSDYDMG</u>WFRQGPGKEREFVA<u>AISWS
GGHTNYADSVKG</u>RFTISRDNSKNTLYLQMNSLRAEDTAVYYCAA<u>DLRFTGGDTTT
PETYDY</u>WGQGTLVTVSS (SEQ ID NO:69)

sdCDR1 <u>GRTFSDYDMG</u> (SEQ ID NO:70)
sdCDR2 <u>AISWSGGHTNYADSVKG</u> (SEQ ID NO:71)
sdCDR3 <u>DLRFTGGDTTTPETYDY</u> (SEQ ID NO:72)

acEpCAM hVIB666

QVQLVESGGGLVQPGRSLRLSCAAS<u>GRTLDNYDMG</u>WFRQGPGKEREFVA<u>AISWS
GGSTDYAYSVTG</u>RFTISRDNAKNSLYLQMNSLRAEDTALYYCAA<u>DLRFTGGDTMT
PETYDY</u>WGQGTLVTVSS (SEQ ID NO:73)

sdCDR1 <u>GRTLDNYDMG</u> (SEQ ID NO:74)
sdCDR2 <u>AISWSGGSTDYAYSVTG</u> (SEQ ID NO:75)
sdCDR3 <u>DLRFTGGDTMTPETYDY</u> (SEQ ID NO:76)

aTrop2 hVIB557

QVQLLESGGGLVQPGGSLRLSCAAS<u>GRTFSSQSMG</u>WFRQAPGKEREFVS<u>AISWT
GANPTYADSVKG</u>RFTISRDNSKNTLYLQMNSLRAEDTAVYYCAA<u>DTSGGSYYYER
ATAETSYDY</u>WGQGTLVTVSS (SEQ ID NO:77)

sdCDR1 <u>GRTFSSQSMG</u> (SEQ ID NO:78)
sdCDR2 <u>AISWTGANPTYADSVKG</u> (SEQ ID NO:79)
sdCDR3 <u>DTSGGSYYYERATAETSYDY</u> (SEQ ID NO:80)

aTrop2 hVIB565

QVQLLESGGGLVQPGGSLRLSCAAS<u>GFTFDYYAIG</u>WFRQAPGKEREGVS<u>CISSSH
GSTYYADSVKG</u>RFTISRDNSKNTVYLQMNSLRAEDTAVYYCAT<u>AGDGGDYHCSGL
VDYGMDY</u>WGKGTLVTVSS (SEQ ID NO:81)

sdCDR1 <u>GFTFDYYAIG</u> (SEQ ID NO:82)
sdCDR2 <u>CISSSHGSTYYADSVKG</u> (SEQ ID NO:83)
sdCDR3 <u>AGDGGDYHCSGLVDYGMDY</u> (SEQ ID NO:84)

Figure 5F aTrop2 hVIB575

QVQLLESGGGLVQPGGSLRLSCLASGRTVGRTAMGWFRQPPGKEREFVATISWA GGTTYYADFVKGRFTISRDNSKNTLYLQMNSLRAEDTAVYYCAASEPYSDYDPSG MVYWGKGTLVTVSS  (SEQ ID NO:85)

sdCDR1 GRTVGRTAMG (SEQ ID NO:86)
sdCDR2 TISWAGGTTYYADFVKG (SEQ ID NO:87)
sdCDR3 SEPYSDYDPSGMVY (SEQ ID NO:88)

aTrop2 hVIB578

QVQLLESGGGLVQPGGSLRLSCAASGRTFGRAAMGWFRQPPGKEREFAATISWS GSNTYYADFVKGRFTISRDNSKNTVYLQMNSLRAEDTAVYYCAASEPYSDYDPSG MVYWGKGTLVTVSS  (SEQ ID NO:89)

sdCDR1 GRTFGRAAMG (SEQ ID NO:90)
sdCDR2 TISWSGSNTYYADFVKG (SEQ ID NO:91)
sdCDR3SEPYSDYDPSGMVY (SEQ ID NO:92)

aTrop2 hVIB609

QVQLLESGGGLVQPGGSLRLSCALSGLTFNTYPMAWFRQPPGQEREFVADMSW SGTNTYYADSVKGRFTISRDNSKNTLYLQMNSLRAEDTAVYYCAAGWPYSGTGRS TTDYTYWGQGTLVTVSS (SEQ ID NO:93)

sdCDR1 GLTFNTYPMA (SEQ ID NO:94)
sdCDR2 DMSWSGTNTYYADSVKG (SEQ ID NO:95)
sdCDR3 GWPYSGTGRSTTDYTY (SEQ ID NO:96)

aTrop2 hVIB619

QVQLLESGGGLVQPGGSLRLSCAASGRSFSRYGMGWLRQAPGKERELVASISWS GHSTYYADSVKGRFTISRDNSKNTLYLQMNSLRAEDTAVYYCAAESLPYESGSPR LTDFASWGQGTLVTVSS (SEQ ID NO:97)

sdCDR1 GRSFSRYGMG (SEQ ID NO:98)
sdCDR2 SISWSGHSTYYADSVKG (SEQ ID NO:99)
sdCDR3 ESLPYESGSPRLTDFAS (SEQ ID NO:100)

aCA9 hVIB456 sdAb

QVQLVESGGGLVQPGGSLRLSCAASGSALIINAMGWYRQAPGKQRELVATVTRS GRTNYADSVKGRFTISRDNSKNTLYLQMNSLRAEDTAVYYCNVALWIADGEYDYW GQGTLVTVSS (SEQ ID NO:101)
sdCDR1 GSALIINAMG (SEQ ID NO:102)
sdCDR2 TVTRSGRTNYADSVKG (SEQ ID NO:103)
sdCDR3 ALWIADGEYDY (SEQ ID NO:104)

Figure 5G aCA9 hVIB476 sdAb

QVQLVESGGGLVQPGGSLRLSCAAS<u>GNIFIINVMG</u>WYRQAPGKQRELVA<u>TITNGG
RTHYADSVKG</u>RFTISRDNSKNTLYLQMNSLRAEDTAVYYCNA<u>NHIELGDY</u>WGQGT
LVTVSS (SEQ ID NO:105)

sdCDR1 <u>GNIFIINVMG</u> (SEQ ID NO:106)
sdCDR2 <u>TITNGGRTHYADSVKG</u> (SEQ ID NO:107)
sdCDR3 <u>NHIELGDY</u> (SEQ ID NO:108)

aCA9 hVIB407 sdAb

QVQLVESGGGLVQPGGSLRLSCTAS<u>GIIFSVYDMG</u>WYRQTPGKQREFVA<u>RITAGG
GTYLTDSVKG</u>RFTISRDNSKNTLYLQMNSLRAEDTGVYYCNA<u>AWIGDDY</u>WGQGTL
VTVSS (SEQ ID NO:109)

sdCDR1 <u>GIIFSVYDMG</u> (SEQ ID NO:110)
sdCDR2 <u>RITAGGGTYLTDSVKG</u> (SEQ ID NO:111)
sdCDR3 <u>AWIGDDY</u> (SEQ ID NO:112)

aCA9 hVIB445 sdAb

QVQLVESGGGLVKPGGSLRLSCAAS<u>GITFNLHAMR</u>WYRRAPGKQRELVA<u>YISARD
WTNYADSVKG</u>RFTISRDNAKNSLYLQMNSLRAEDTAVYYCNT<u>DLVGEDY</u>WGRGT
LVTVSS (SEQ ID NO:113)

sdCDR1 <u>GITFNLHAMR</u> (SEQ ID NO:114)
sdCDR2 <u>YISARDWTNYADSVKG</u> (SEQ ID NO:115)
sdCDR3 <u>DLVGEDY</u> (SEQ ID NO:116)

aHSA half-life extension domain (aHSA (10GE))

EVQLVESGGGLVQPGNSLRLSCAAS<u>GFTFSKFGMS</u>WVRQAPGKGLEWVS<u>SISGS
GRDTLYAESVKG</u>RFTISRDNAKTTLYLQMNSLRPEDTAVYYCTI<u>GGSLSV</u>SSQGTL
VTVSS (SEQ ID NO:117)

sdCDR1 <u>GFTFSKFGMS</u> (SEQ ID NO:118)
sdCDR2 <u>SISGSGRDTLYAESVKG</u> (SEQ ID NO:119)
sdCDR3 <u>GGSLSV</u> (SEQ ID NO:120)

Figure 5H

αHSA half-life extension domain with His tag

EVQLVESGGGLVQPGNSLRLSCAASGFTFSKFGMSWVRQAPGKGLEWVSSISGS GRDTLYAESVKGRFTISRDNAKTTLYLQMNSLRPEDTAVYYCTIGGSLSVSSQGTL VTVSS/HHHHHH (SEQ ID NO:121)

sdCDR1 GFTFSKFGMS (SEQ ID NO:122)
sdCDR2 SISGSGRDTLYAESVKG (SEQ ID NO:123)
sdCDR3 GGSLSV (SEQ ID NO:124)

αCD3 scFv domains

αCD3 V_L

QTVVTQEPSLTVSPGGTVTLTCASSTGAVTSGNYPNWVQQKPGQAPRGLIGGTKF LVPGTPARFSGSLLGGKAALTLSGVQPEDEAEYYCTLWYSNRWVFGGGTKLTVL (SEQ ID NO:126)

aVLCDR1 ASSTGAVTSGNYPN (SEQ ID NO:127)

aVLsdCDR2 GTKFLVP (SEQ ID NO:128)

aVLsdCDR3 TLWYSNRWV (SEQ ID NO:129)

αCD3 V_LI

QTVVTQEPSLTVSPGGTVTLTCGSSTGAVTSGNYPNWVQQKPGQAPRGLIGDYK DDDDKGTPARFSGSLLGGKAALTLSGVQPEDEAEYYCVLWYSNRWVFGGGTKLT VL (SEQ ID NO:130)

iVLCDR1 GSSTGAVTSGNYPN (SEQ ID NO:131)

iVLsdCDR2 DYKDDDDK (SEQ ID NO:132)

iVLsdCDR3 VLWYSNRWV (SEQ ID NO:133)

αCD3 V_LI2

QTVVTQEPSLTVSPGGTVTLTCGSSTGAVTSGNYPNWVQQKPGQAPRGLIGGTK DDAPGTPARFSGSLLGGKAALTLSGVQPEDEAEYYCVLWYSNRWVFGGGTKLTV L (SEQ ID NO:134)

iVLCDR1 GSSTGAVTSGNYPN (SEQ ID NO:135)

iVLsdCDR2 GTKDDAP (SEQ ID NO:136)

iVLsdCDR3 VLWYSNRWV (SEQ ID NO:137)

Figure 5I

αCD3 V_LiGL

QTVVTQEPSLTVSPGGTVTLTC<u>GSSTGAVTSGHYPN</u>WVQQKPGQAPRGLIG<u>GTS
NKHS</u>WTPARFSGSLLGGKAALTLSGVQPEDEAEYYC<u>VLWGSRRWV</u>FGGGTKLTV
L (SEQ ID NO:138)

aV_LiGLCDR1  <u>GSSTGAVTSGHYPN</u>  (SEQ ID NO:139)

aV_LiGLCDR2  <u>GTSNKHS</u>  (SEQ ID NO:140)

aV_LiGLCDR3  <u>VLWGSRRWV</u>  (SEQ ID NO:141)

αCD3 V_H

EVQLVESGGGLVQPGGSLKLSCAAS<u>GFTFNKYAIN</u>WVRQAPGKGLEWVA<u>RIRSKY
NNYATYYADQVKD</u>RFTISRDDSKNTAYLQMNNLKTEDTAVYYCVR<u>HANFGNSYIS
YWAY</u>WGQGTLVTVSS (SEQ ID NO:142)

aVHCDR1  <u>GFTFNKYAIN</u>  (SEQ ID NO:143)

aVHsdCDR2  <u>RIRSKYNNYATYYADQVKD</u>  (SEQ ID NO:144)

aVHsdCDR3  <u>HANFGNSYISYWAY</u>  (SEQ ID NO:145)

αCD3 V_Hi

EVQLVESGGGLVQPGGSLKLSCAAS<u>GFTFNKYAMN</u>WVRQAPGKGLEWVA<u>RIRSK
YDYKDDDDKADSVKD</u>RFTISRDDSKNTAYLQMNNLKTEDTA<u>VYYCVRHGNFGNSY
ISYWAY</u>WGQGTLVTVSS (SEQ ID NO:146)

iVHsdCDR1  <u>GFTFNKYAMN</u>  (SEQ ID NO:147)

iVHsdCDR2  <u>RIRSKYDYKDDDDKADSVKD</u>  (SEQ ID NO:148)

iVHsdCDR3  <u>HGNFGNSYISYWAY</u>  (SEQ ID NO:149)

αCD3 V_Hi2

EVQLVESGGGLVQPGGSLKLSCAAS<u>GFTFNKHAMN</u>WVRQAPGKGLEWVA<u>RIRSK
YNNYATAYADSVKD</u>RFTISRDDSKNTAYLQMNNLKTEDTAVYYCVR<u>HGNFGNSYI
SYWAY</u>WGQGTLVTVSS (SEQ ID NO:150)

iVHsdCDR1  <u>GFTFNKHAMN</u>  (SEQ ID NO:151)

iVHsdCDR2  <u>RIRSKYNNYATAYADSVKD</u>  (SEQ ID NO:152)

iVHsdCDR3  <u>HGNFGNSYISYWAY</u>  (SEQ ID NO:153)

Figure 5J
αCD3 VHiGL4
EVQLVESGGGLVQPGGSLKLSCAASGFTFSGYAMNWVRQAPGKGLEWVA**RIRSK
ANSYATEYAASVKDRFTISRDDSKNTAYLQMNNLKTEDTAVYYCVRHGNAGNSAI
SYWAY**WGQGTLVTVSS  (SEQ ID NO:154)

aVHiGL4CDR1  GFTFSGYAMN (SEQ ID NO:155)

aVHiGL4CDR2  RIRSKANSYATEYAASVKD (SEQ ID NO:156)

aVHiGL4CDR3  HGNAGNSAISYWAY (SEQ ID NO:157)

αCD3 scFv linkers

Normal/Non-cleavable linker

GGGGSGGGGSGGGGS (SEQ ID NO:232)

Constrained linker

GGGSGGGS (SEQ ID NO:233)

Figure 6A

Cleavable Linkers (Recognition site in bold, cleavage site marked with"/")

MMP 2/9

GPAG/MKGL (SEQ ID NO:158)

SGGPGPAG/MKGLPGS (SEQ ID NO:159)

SGGGPGPAG/MKGLPGGS (SEQ ID NO:160)

Meprin A/B

GGGGKKLA/DEPEGGGS (SEQ ID NO:161)

SGGGKKLA/DEPEGGS (SEQ ID NO:162)

KKLA/DEPE (SEQ ID NO:163)

Meprin A/B (Variant, high efficiency)

GGGKFLA/DEPEGG (SEQ ID NO:164)

Cathepsin S, K, L

GGGARLQ/SAAPGGGS (SEQ ID NO:165)

SGGGARLQ/SAAPGGGS (SEQ ID NO:166)

ARLQ/SAAP (SEQ ID NO:167)

Meprin/Granzyme B

SGGGGVYADSLEDGGGGS (SEQ ID NO:168)

GVYADSLEDG (SEQ ID NO:169)

Matriptase/uPA (MS)

GGGSLSGR/SDNHGGGS (SEQ ID NO:170)

GLSGR/SDNHG (SEQ ID NO:171)

Matriptase (MV)

SGGGSFTR/QARVVGGGS (SEQ ID NO:172)

SFTR/QARVV (SEQ ID NO:173)

CathepsinS/MMP9/Meprin A

ARLQ/SAAPAG/LKGA (SEQ ID NO:174)

GARLQ/SAAPAG/LKGAG (SEQ ID NO:175)

Figure 6B

MMP9 (Variant, high efficiency)

GGPGPAG/MHGLPG (SEQ ID NO:176)

GSGGPGPAG/MHGLPGGS (SEQ ID NO:177)

MMP9 (Variant, low efficiency)

GGPGPAG/MEGLPG (SEQ ID NO:178)

MMP9-15 (K>E)

SGGPGPAG/MEGLPGS (SEQ ID NO:179)

MMP9-15 (M>P)

SGGPGPAG/PKGLPGS (SEQ ID NO:180)

Thrombin 1

GGGGLVPR/GSLGGGGS (SEQ ID NO:181)

Thrombin 2

SSGGGMPR/SFRGGGS (SEQ ID NO:182)

Enterokinase/Flag

GGGGDYKDDDDK/GGGS (SEQ ID NO:183)

KLK7-6

SGGGQNPY/SAGRGGGS (SEQ ID NO:184)

KLK7-13

SGGGQNPY/SAGGGSGG (SEQ ID NO:185)

KLK7-11

SGGGRNVY/SAGGGSGG (SEQ ID NO:186)

KLK7-10

SGGGQNTW/SAGKGGGS (SEQ ID NO:187)

uPA

GGGSHTGR/SAYFGGGS (SEQ ID NO:188)

MMP9-2

SGGPGPAG/LKGAPGS (SEQ ID NO:189)

Figure 6C

| Protease | Cleavage domain sequence | SEQ ID NO: |
|---|---|---|
| MMP7 | KRALGLPG | 190 |
| MMP7 | (DE)₈RPLALWRS(DR)₈ | 191 |
| MMP9 | PR(S/T)(L/I)(S/T) | 192 |
| MMP9 | LEATA | 193 |
| MMP11 | GGAANLVRGG | 194 |
| MMP14 | SGRIGFLRTA | 195 |
| MMP | PLGLAG | 196 |
| MMP | PLGLAX | 197 |
| MMP | PLGC(ME)AG | 198 |
| MMP | ESPAYYTA | 199 |
| MMP | RLQLKL | 200 |
| MMP | RLQLKAC | 201 |
| MMP2, MMP9, MMP14 | EP(CIT)G(HOF)YL | 202 |
| Urokinase plasminogen activator (upa) | SGRSA | 203 |
| Urokinase plasminogen activator (upa) | DAFK | 204 |
| Urokinase plasminogen activator (upa) | GGGRR | 205 |
| Lysosomal enzyme | GFLG | 206 |
| Lysosomal enzyme | ALAL | 207 |
| Lysosomal enzyme | FK | 208 |
| Cathepsin B | NLL | 209 |
| Cathepsin D | PIC(ET)FF | 210 |
| Cathepsin K | GGPRGLPG | 211 |
| Prostate specific antigen | HSSKLQ | 212 |
| Prostate specific antigen | HSSKLQL | 213 |
| Prostate specific antigen | HSSKLQEDA | 214 |
| Herpes simplex virus protease | LVLASSSFGY | 215 |
| HIV protease | GVSQNYPIVG | 216 |
| CMV protease | GVVQASCRLA | 217 |

Figure 6D

| Protease | Cleavage domain sequence | SEQ ID NO: |
|---|---|---|
| Thrombin | F(PIP)RS | 218 |
| Thrombin | DPRSFL | 219 |
| Thrombin | PPRSFL | 220 |
| Caspase-3 | DEVD | 221 |
| Caspase-3 | DEVDP | 222 |
| Caspase-3 | KGSGDVEG | 223 |
| Interleukin 1β converting enzyme | GWEHDG | 224 |
| Enterokinase | EDDDDKA | 225 |
| Fap | KQEQNPGST | 226 |
| Kallikrein 2 | GKAFRR | 227 |
| Plasmin | DAFK | 228 |
| Plasmin | DVLK | 229 |
| Plasmin | DAFK | 230 |
| Top | ALLLALL | 231 |

Figure 41

| sdAb | | Protein Binding: $K_D$(nM) | | | Cell Binding: | | TDCC $EC_{50}$(pM) | |
|---|---|---|---|---|---|---|---|---|
| MVK ID | family | Human | Rhesus | Mouse | Human | Rhesus | IGROV1 | OVAR8 |
| 77-2 | 2 | 2 | 3 | 7 | +++ | +++ | 2 | 0.2 |
| 59-3 | 3 | 15 | 53 | NB | +++ | +++ | 30 | 6 |
| 22-4 | 4 | 2 | 11 | NB | +++ | +++ | 8 | 1 |
| Pro51 | | | | | | | 41 | 2 |

Figure 50

| Clone | Binding Affinity (nM) | | Cross-Reactivity |
|---|---|---|---|
| | Human | Cyno | Cyno/Human |
| VIB-13 | 2.3 | 11.6 | 5 |
| hVIB-13 | 2.8 | 12.7 | 4.5 |
| VIB-23 | 4.2 | 46.7 | 11.1 |
| hVIB-23 | 4.1 | 51.8 | 12.6 |

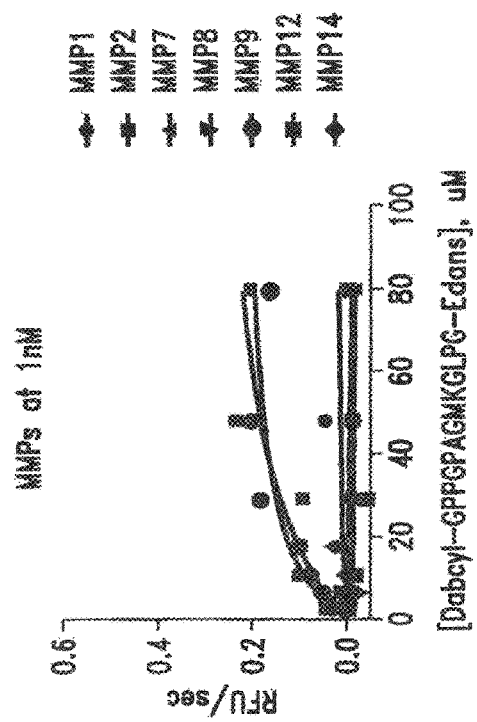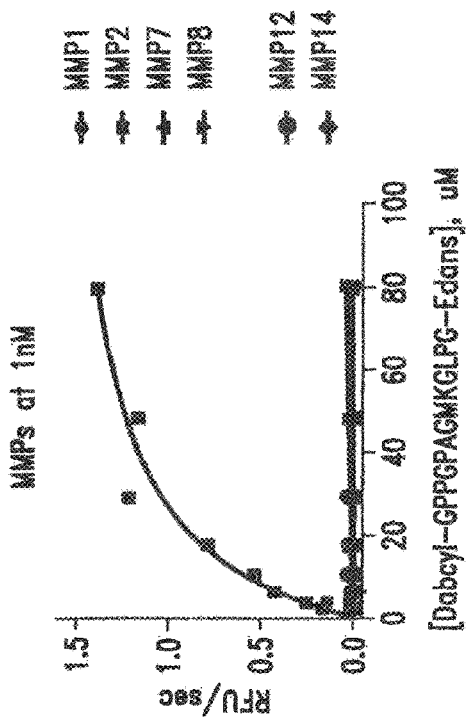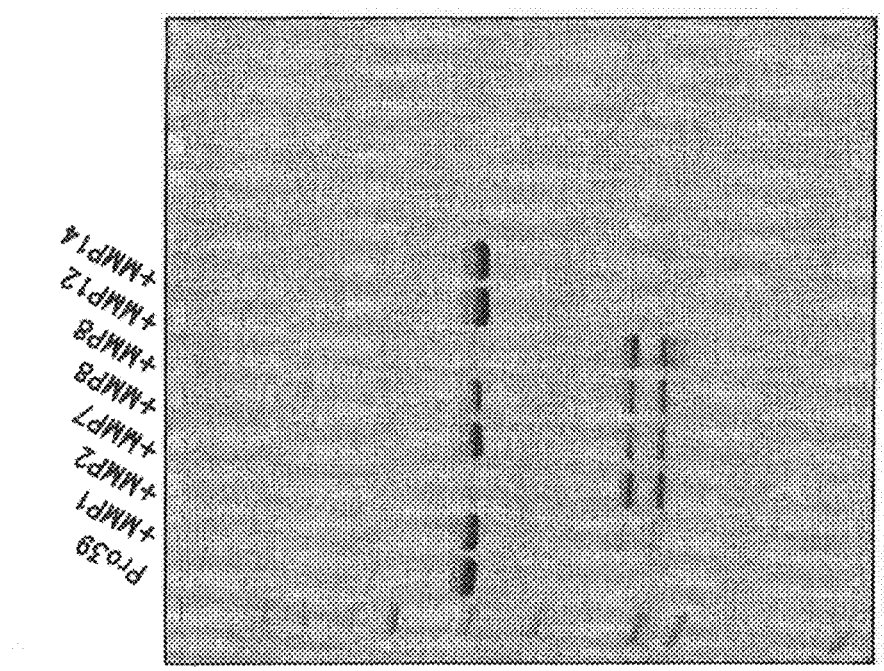

Figure 61A

Format 2

Pro186 – EGFR2/MMP9 (aEGFR),

Pro225 – hF7/MMP9 (aB7H3)

Pro226 – hF12/MMP9 (aB7H3)

Pro233 – hEGFR2/MMP9 (aEGFR)

Pro311 – h77.2/MMP9 (aFOLR1)

Pro312 – h59.3/MMP9 (aFOLR1)

Pro313 – h22.4/MMP9 (aFOLR1)

Pro495 – hF7 MMP9 Vli2 + Vhi2 (aB7H3)

Format 2 - Heterologous

Pro246 – hEGFR1/hEGFR2 MMP9 (aEGFR)

Pro254 – hEGFR2/hEGFR1 MMP9 (aEGFR)

Pro255 – hEGFR2/h13 MMP9 (aEGFR/aEpCAM)

Pro256 – h13/hEGFR2 MMP9 (aEpCAM/aEGFR)

Pro420 – h77.2/hEGFR2 MMP9 (aFOLR1/aEGFR)

Pro421 – hEGFR2/h77.2 MMP9 (aEGFR/aFOLR1)

Pro432 - h13/hEGFR1 MMP9 (aEpCAM/aEGFR)

Pro479 – hF7/hF12 MMP9 (aB7H3)

Pro480 – hF12/hF7 MMP9 (aB7H3)

Dual Targeting Hemis (Format 3)

Pro448 – h77.2/hEGFR2 MMP9 VH (aFOLR1/aEGFR)

Pro449 – hEGFR2/h77.2 MMP9 VH (aEGFR/aFOLR1)

Pro450 – h77.2/hEGFR2 MMP9 VL (aFOLR1/aEGFR)

Pro451 – hEGFR2/h77.2 MMP9 VL (aEGFR/aFOLR1)

Figure 61B

Format 1

Pro140 – EGFR2 MMP9 (aEGFR)

Pro140b – EGFR2 Meprin (aEGFR)

Format 2 – Cleavable Linker Variants

Pro187 – EGFR2/Meprin (aEGFR)

Pro221 – EGFR2/KLK7-6 (aEGFR)

Pro222 – EGFR2/KLK7-13 (aEGFR)

Pro223 – EGFR2/KLK7-11 (aEGFR)

Pro224 – EGFR2/KLK7-10 (aEGFR)

Pro393 – EGFR2/S9 (aEGFR)

Pro394 – EGFR2/ST14MV (aEGFR)

Pro395 – EGFR2/CathS (aEGFR)

Pro396 – EGFR2/MMP9v (aEGFR)

Pro429 – EGFR2/Meprin/GranzymeB (aEGFR)

Pro430 – EGFR2/MMP9-2 (aEGFR)

Pro431 – EGFR2/ST14MS (aEGFR)

Format 4

Pro258 – hEGFR2 MMP9 (aEGFR)

Pro356 – hEGFR1 MMP9 (aEGFR)

Pro359 – hF7 MMP9 (aB7H3)

Pro388 – h77.2 MMP9 (aFOLR1)

Pro364 – h59.3 MMP9 (aFOLR1)

Figure 62A

Pro140 (Format 1)

QVKLEESGGGSVQTGGSLRLTCAASGRTSRSYGMGWFRQAPGKEREFVSGISWRGDSTGYAD SVKGRFTISRDNAKNTVDLQMNSLKPEDTAIYYCAAAAGSAWYGTLYEYDYWGQGTQVTVSS/ *GGGSGGGS*/EVQLVESGGGLVQPGGSLKLSCAASGFTFNKYAINWVRQAPGKGLEWVARIRSK YNNYATYYADQVKDRFTISRDDSKNTAYLQMNNLKTEDTAVYYCVRHANFGNSYISYWAYWG QGTLVTVSS/*GPAGMKGL*/QTVVTQEPSLTVSPGGTVTLTCASSTGAVTSGNYPNWVQQKPGQ APRGLIGGTKFLVPGTPARFSGSLLGGKAALTLSGVQPEDEAEYYCTLWYSNRWVFGGGTKLTVL /*GGGSGGGS*/QVKLEESGGGSVQTGGSLRLTCAASGRTSRSYGMGWFRQAPGKEREFVSGISW RGDSTGYADSVKGRFTISRDNAKNTVDLQMNSLKPEDTAIYYCAAAAGSAWYGTLYEYDYWG QGTQVTVSS/*SGGPGPAGMKGLPGS*/QTVVTQEPSLTVSPGGTVTLTCGSSTGAVTSGNYPNW VQQKPGQAPRGLIGDYKDDDDKGTPARFSGSLLGGKAALTLSGVQPEDEAEYYCVLWYSNRW VFGGGTKLTVL/*GGGSGGGS*/EVQLVESGGGLVQPGGSLKLSCAASGFTFNKYAMNWVRQAP GKGLEWVARIRSKYDYKDDDDKADSVKDRFTISRDDSKNTAYLQMNNLKTEDTAVYYCVRHG NFGNSYISYWAYWGQGTLVTVSS/*GGGGSGGGS*/EVQLVESGGGLVQPGNSLRLSCAASGFTF SKFGMSWVRQAPGKGLEWVSSISGSGRDTLYAESVKGRFTISRDNAKTTLYLQMNSLRPEDTA VYYCTIGGSLSVSSQGTLVTVSS (SEQ ID NO:234)

Pro140b Format 1

QVKLEESGGGSVQTGGSLRLTCAASGRTSRSYGMGWFRQAPGKEREFVSGISWRGDSTGYAD SVKGRFTISRDNAKNTVDLQMNSLKPEDTAIYYCAAAAGSAWYGTLYEYDYWGQGTQVTVSS/ *GGGSGGGS*/EVQLVESGGGLVQPGGSLKLSCAASGFTFNKYAINWVRQAPGKGLEWVARIRSK YNNYATYYADQVKDRFTISRDDSKNTAYLQMNNLKTEDTAVYYCVRHANFGNSYISYWAYWG QGTLVTVSS/*KKLADEPE*/QTVVTQEPSLTVSPGGTVTLTCASSTGAVTSGNYPNWVQQKPGQA PRGLIGGTKFLVPGTPARFSGSLLGGKAALTLSGVQPEDEAEYYCTLWYSNRWVFGGGTKLTVL/ *GGGSGGGS*/QVKLEESGGGSVQTGGSLRLTCAASGRTSRSYGMGWFRQAPGKEREFVSGISW RGDSTGYADSVKGRFTISRDNAKNTVDLQMNSLKPEDTAIYYCAAAAGSAWYGTLYEYDYWG QGTQVTVSS/*GGGSKKLADEPEGGGS*/QTVVTQEPSLTVSPGGTVTLTCGSSTGAVTSGNYPN WVQQKPGQAPRGLIGDYKDDDDKGTPARFSGSLLGGKAALTLSGVQPEDEAEYYCVLWYSNR WVFGGGTKLTVL/*GGGSGGGS*/EVQLVESGGGLVQPGGSLKLSCAASGFTFNKYAMNWVRQA PGKGLEWVARIRSKYDYKDDDDKADSVKDRFTISRDDSKNTAYLQMNNLKTEDTAVYYCVRHG NFGNSYISYWAYWGQGTLVTVSS/*GGGGSGGGS*/EVQLVESGGGLVQPGNSLRLSCAASGFTF SKFGMSWVRQAPGKGLEWVSSISGSGRDTLYAESVKGRFTISRDNAKTTLYLQMNSLRPEDTA VYYCTIGGSLSVSSQGTLVTVSS (SEQ ID NO:235)

Figure 62B

Pro186 Format 2

QVKLEESGGGSVQTGGSLRLTCAASGRTSRSYGMGWFRQAPGKEREFVSGISWRGDSTGYAD SVKGRFTISRDNAKNTVDLQMNSLKPEDTAIYYCAAAAGSAWYGTLYEYDYWGQGTQVTVSS/ *GGGSGGGS*/EVQLVESGGGLVQPGGSLKLSCAASGFTFNKYAINWVRQAPGKGLEWVARIRSK YNNYATYYADQVKDRFTISRDDSKNTAYLQMNNLKTEDTAVYYCVRHANFGNSYISYWAYWG QGTLVTVSS/*GGGSGGGS*/QTVVTQEPSLTVSPGGTVTLTCASSTGAVTSGNYPNWVQQKPGQ APRGLIGGTKFLVPGTPARFSGSLLGGKAALTLSGVQPEDEAEYYCTLWYSNRWVFGGGTKLTVL /*GGGSGGGS*/QVKLEESGGGSVQTGGSLRLTCAASGRTSRSYGMGWFRQAPGKEREFVSGISW RGDSTGYADSVKGRFTISRDNAKNTVDLQMNSLKPEDTAIYYCAAAAGSAWYGTLYEYDYWG QGTQVTVSS/*SGGPGPAGMKGLPGS*/QTVVTQEPSLTVSPGGTVTLTCGSSTGAVTSGNYPNW VQQKPGQAPRGLIGDYKDDDDKGTPARFSGSLLGGKAALTLSGVQPEDEAEYYCVLWYSNRW VFGGGTKLTVL/*GGGSGGGS*/EVQLVESGGGLVQPGGSLKLSCAASGFTFNKYAMNWVRQAP GKGLEWVARIRSKYDYKDDDDKADSVKDRFTISRDDSKNTAYLQMNNLKTEDTAVYYCVRHG NFGNSYISYWAYWGQGTLVTVSS/*GGGGSGGGS*/EVQLVESGGGLVQPGNSLRLSCAASGFTF SKFGMSWVRQAPGKGLEWVSSISGSGRDTLYAESVKGRFTISRDNAKTTLYLQMNSLRPEDTA VYYCTIGGSLSVSSQGTLVTVSS (SEQ ID NO:236)

Pro187 Format 2

QVKLEESGGGSVQTGGSLRLTCAASGRTSRSYGMGWFRQAPGKEREFVSGISWRGDSTGYAD SVKGRFTISRDNAKNTVDLQMNSLKPEDTAIYYCAAAAGSAWYGTLYEYDYWGQGTQVTVSS/ *GGGSGGGS*/EVQLVESGGGLVQPGGSLKLSCAASGFTFNKYAINWVRQAPGKGLEWVARIRSK YNNYATYYADQVKDRFTISRDDSKNTAYLQMNNLKTEDTAVYYCVRHANFGNSYISYWAYWG QGTLVTVSS/*GGGSGGGS*/QTVVTQEPSLTVSPGGTVTLTCASSTGAVTSGNYPNWVQQKPGQ APRGLIGGTKFLVPGTPARFSGSLLGGKAALTLSGVQPEDEAEYYCTLWYSNRWVFGGGTKLTVL /*GGGSGGGS*/QVKLEESGGGSVQTGGSLRLTCAASGRTSRSYGMGWFRQAPGKEREFVSGISW RGDSTGYADSVKGRFTISRDNAKNTVDLQMNSLKPEDTAIYYCAAAAGSAWYGTLYEYDYWG QGTQVTVSS/*GGGSKKLADEPEGGGS*/QTVVTQEPSLTVSPGGTVTLTCGSSTGAVTSGNYPN WVQQKPGQAPRGLIGDYKDDDDKGTPARFSGSLLGGKAALTLSGVQPEDEAEYYCVLWYSNR WVFGGGTKLTVL/*GGGSGGGS*/EVQLVESGGGLVQPGGSLKLSCAASGFTFNKYAMNWVRQA PGKGLEWVARIRSKYDYKDDDDKADSVKDRFTISRDDSKNTAYLQMNNLKTEDTAVYYCVRHG NFGNSYISYWAYWGQGTLVTVSS/*GGGGSGGGS*/EVQLVESGGGLVQPGNSLRLSCAASGFTF SKFGMSWVRQAPGKGLEWVSSISGSGRDTLYAESVKGRFTISRDNAKTTLYLQMNSLRPEDTA VYYCTIGGSLSVSSQGTLVTVSS (SEQ ID NO:237)

Figure 62C

Pro225 (FL aB7H3 hF7 MMP9 linker) Format 2

QVQLQESGGGLVQPGGSLRLSCAPS<u>RRTFHTYHMG</u>WFRQAPGKEREFVA<u>VINWSGGSTVYAD
SV</u>KGRFTISRDNSKNTLYLQMNSLRAEDTAVYYCA<u>AGGATTQRATEASYDY</u>WGQGTLVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVQLQESGGGLVQPGGSLRLSCAPS<u>RRTFHTYHMG</u>WFRQAPGKEREFVA<u>VINW
SGGSTVYADSV</u>KGRFTISRDNSKNTLYLQMNSLRAEDTAVYYCA<u>AGGATTQRATEASYDY</u>WGQ
GTLVTVSS/*<u>SGGPGPAGMKGLPGS</u>*/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:238)

Pro226 (FL aB7H3 hF12 MMP9 linker) Format 2

QVQLQESGGGLVQPGGSLRLSCEAS<u>PRTFSTYSMA</u>WFRQAPGKERSFVA<u>AINWSGGNTSYADS
V</u>KGRFTISRDNSKNTLYLQMNSLRAEDTAVYYCA<u>AGGVLAHHNYEYDY</u>WGQGTLVTVSS/<u>GGG
SGGGS</u>/EVQLVESGGGLVQPGGSLKLSCAASGFTFNKYAINWVRQAPGKGLEWVARIRSKYNNY
ATYYADQVKDRFTISRDDSKNTAYLQMNNLKTEDTAVYYCVRHANFGNSYISYWAYWGQGTLV
TVSS/<u>GGGSGGGS</u>/QTVVTQEPSLTVSPGGTVTLTCASSTGAVTSGNYPNWVQQKPGQAPRGLI
GGTKFLVPGTPARFSGSLLGGKAALTLSGVQPEDEAEYYCTLWYSNRWVFGGGTKLTVL/<u>GGGS
GGGS</u>/QVQLQESGGGLVQPGGSLRLSCEAS<u>PRTFSTYSMA</u>WFRQAPGKERSFVA<u>AINWSGGNT
SYADSV</u>KGRFTISRDNSKNTLYLQMNSLRAEDTAVYYCA<u>AGGVLAHHNYEYDY</u>WGQGTLVTVSS
/*<u>SGGPGPAGMKGLPGS</u>*/QTVVTQEPSLTVSPGGTVTLTCGSSTGAVTSGNYPNWVQQKPGQA
PRGLIGDYKDDDDKGTPARFSGSLLGGKAALTLSGVQPEDEAEYYCVLWYSNRWVFGGGTKLTV
L/<u>GGGSGGGS</u>/EVQLVESGGGLVQPGGSLKLSCAASGFTFNKYAMNWVRQAPGKGLEWVARI
RSKYDYKDDDDKADSVKDRFTISRDDSKNTAYLQMNNLKTEDTAVYYCVRHGNFGNSYISYWAY
WGQGTLVTVSS/<u>GGGGSGGGS</u>/EVQLVESGGGLVQPGNSLRLSCAASGFTFSKFGMSWVRQA
PGKGLEWVSSISGSGRDTLYAESVKGRFTISRDNAKTTLYLQMNSLRPEDTAVYYCTIGGSLSVSS
QGTLVTVSS/HHHHHH (SEQ ID NO:239)

Figure 62D

Pro233 (humanized Pro186) Format 2

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/<u>GG
GSGGGS</u>/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/<u>GGGSGGGS</u>/QTVVTQEPSLTVSPGGTVTLTCASSTGAVTSGNYPNWVQQKPGQAPR
GLIGGTKFLVPGTPARFSGSLLGGKAALTLSGVQPEDEAEYYCTLWYSNRWVFGGGTKLTVL/<u>GG
GSGGGS</u>/QVKLVESGGGVVRPGGSLTLSCAASGRTSRSYGMGWFRQAPGKEREFVSGISWRGD
STGYADSVKGRFTISRDNAKNSLYLQMNSLRAEDTALYYCAAAAGSAWYGTLYEYDYWGQGTL
VTVSS/*<u>SGGPGPAGMKGLPGS</u>*/QTVVTQEPSLTVSPGGTVTLTCGSSTGAVTSGNYPNWVQQK
PGQAPRGLIGDYKDDDDKGTPARFSGSLLGGKAALTLSGVQPEDEAEYYCVLWYSNRWVFGGG
TKLTVL/<u>GGGSGGGS</u>/EVQLVESGGGLVQPGGSLKLSCAASGFTFNKYAMNWVRQAPGKGLE
WVARIRSKYDYKDDDDKADSVKDRFTISRDDSKNTAYLQMNNLKTEDTAVYYCVRHGNFGNSYI
SYWAYWGQGTLVTVSS/<u>GGGGSGGGS</u>/EVQLVESGGGLVQPGNSLRLSCAASGFTFSKFGMS
WVRQAPGKGLEWVSSISGSGRDTLYAESVKGRFTISRDNAKTTLYLQMNSLRPEDTAVYYCTIGG
SLSVSSQGTLVTVSS/HHHHHH (SEQ ID NO:240)

Pro311 (FL aFOLR1 h77.2 MMP9 linker) format 2

QVQLVESGGGLVQPGGSLRLSCAASGFTVSNSVMAWYRQTPGNEREFVAIINSIGITNYADSVK
GRFTISRDNSKNTLYLQMNSLRAEDTAVYVCNRNFDRIYWGQGTLVTVSS/<u>GGGSGGGS</u>/EVQL
VESGGGLVQPGGSLKLSCAASGFTFNKYAINWVRQAPGKGLEWVARIRSKYNNYATYYADQVK
DRFTISRDDSKNTAYLQMNNLKTEDTAVYYCVRHANFGNSYISYWAYWGQGTLVTVSS/<u>GGGS
GGGS</u>/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/<u>GGGSGGGS</u>/QVQL
VESGGGLVQPGGSLRLSCAASGFTVSNSVMAWYRQTPGNEREFVAIINSIGITNYADSVKGRFTIS
RDNSKNTLYLQMNSLRAEDTAVYVCNRNFDRIYWGQGTLVTVSS/*<u>SGGPGPAGMKGLPGS</u>*/QT
VVTQEPSLTVSPGGTVTLTCGSSTGAVTSGNYPNWVQQKPGQAPRGLIGDYKDDDDKGTPARF
SGSLLGGKAALTLSGVQPEDEAEYYCVLWYSNRWVFGGGTKLTVL/<u>GGGSGGGS</u>/EVQLVESGG
GLVQPGGSLKLSCAASGFTFNKYAMNWVRQAPGKGLEWVARIRSKYDYKDDDDKADSVKDRF
TISRDDSKNTAYLQMNNLKTEDTAVYYCVRHGNFGNSYISYWAYWGQGTLVTVSS/<u>GGGGSGG
GS</u>/EVQLVESGGGLVQPGNSLRLSCAASGFTFSKFGMSWVRQAPGKGLEWVSSISGSGRDTLYA
ESVKGRFTISRDNAKTTLYLQMNSLRPEDTAVYYCTIGGSLSVSSQGTLVTVSS/HHHHHH (SEQ
ID NO:241)

Figure 62E

<u>Pro312 (FL aFOLR1 h59.3 MMP9 linker)</u>

QVQLVESGGGLVQPGGSLRLSCAAPGNTFSISAMGWYRQAPGKQREWVAVTHSDYSTNYADS
VKGRFTISRDNSKNTLYLQMNSLRAEDTAVYYCKHYGIDYWGQGTLVTVSS/<u>GGGSGGGS</u>/EVQ
LVESGGGLVQPGGSLKLSCAASGFTFNKYAINWVRQAPGKGLEWVARIRSKYNNYATYYADQVK
DRFTISRDDSKNTAYLQMNNLKTEDTAVYYCVRHANFGNSYISYWAYWGQGTLVTVSS/<u>GGGS</u>
<u>GGGS</u>/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/<u>GGGSGGGS</u>/QVQL
VESGGGLVQPGGSLRLSCAAPGNTFSISAMGWYRQAPGKQREWVAVTHSDYSTNYADSVKGR
FTISRDNSKNTLYLQMNSLRAEDTAVYYCKHYGIDYWGQGTLVTVSS/*SGGPGPAGMKGLPGS*/
QTVVTQEPSLTVSPGGTVTLTCGSSTGAVTSGNYPNWVQQKPGQAPRGLIGDYKDDDDKGTPA
RFSGSLLGGKAALTLSGVQPEDEAEYYCVLWYSNRWVFGGGTKLTVL/<u>GGGSGGGS</u>/EVQLVES
GGGLVQPGGSLKLSCAASGFTFNKYAMNWVRQAPGKGLEWVARIRSKYDYKDDDDKADSVKD
RFTISRDDSKNTAYLQMNNLKTEDTAVYYCVRHGNFGNSYISYWAYWGQGTLVTVSS/<u>GGGGS</u>
<u>GGGS</u>/EVQLVESGGGLVQPGNSLRLSCAASGFTFSKFGMSWVRQAPGKGLEWVSSISGSGRDT
LYAESVKGRFTISRDNAKTTLYLQMNSLRPEDTAVYYCTIGGSLSVSSQGTLVTVSS/HHHHHH
(SEQ ID NO:242)

<u>Pro313 (FL aFOLR1 h22.4 MMP9 linker) format 2</u>

QVQLVESGGGLVQPGGSLRLSCEASGTTFSRDVMGWYRQAPGKQRELVAIISRGGSTNYADSV
KGRFTISRDNSKNTLYLQMNSLRAEDTAVYYCNANTATWGRVFWGQGTLVTVSS/<u>GGGSGGGS</u>
/EVQLVESGGGLVQPGGSLKLSCAASGFTFNKYAINWVRQAPGKGLEWVARIRSKYNNYATYYA
DQVKDRFTISRDDSKNTAYLQMNNLKTEDTAVYYCVRHANFGNSYISYWAYWGQGTLVTVSS/
<u>GGGSGGGS</u>/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/<u>GGGSGGGS</u>
/QVQLVESGGGLVQPGGSLRLSCEASGTTFSRDVMGWYRQAPGKQRELVAIISRGGSTNYADSV
KGRFTISRDNSKNTLYLQMNSLRAEDTAVYYCNANTATWGRVFWGQGTLVTVSS/*SGGPGPAG*
*MKGLPGS*/QTVVTQEPSLTVSPGGTVTLTCGSSTGAVTSGNYPNWVQQKPGQAPRGLIGDYKD
DDDKGTPARFSGSLLGGKAALTLSGVQPEDEAEYYCVLWYSNRWVFGGGTKLTVL/<u>GGGSGGG</u>
<u>S</u>/EVQLVESGGGLVQPGGSLKLSCAASGFTFNKYAMNWVRQAPGKGLEWVARIRSKYDYKDDD
DKADSVKDRFTISRDDSKNTAYLQMNNLKTEDTAVYYCVRHGNFGNSYISYWAYWGQGTLVTV
SS/<u>GGGGSGGGS</u>/EVQLVESGGGLVQPGNSLRLSCAASGFTFSKFGMSWVRQAPGKGLEWVSS
ISGSGRDTLYAESVKGRFTISRDNAKTTLYLQMNSLRPEDTAVYYCTIGGSLSVSSQGTLVTVSS/H
HHHHH (SEQ ID NO:243)

Figure 62F

Pro246 (FL haEGFR1/haEGFR2 heterologous COBRA with MMP9 linker)

EVQLVESGGGLVQPGGSLRLSCAASGRTFSSYAMGWFRQAPGKEREFVVAINWSSGSTYYADS
VKGRFTISRDNSKNTLYLQMNSLRAEDTAVYYCAAGYQINSGNYNFKDYEYDYWGQGTLVTVSS
/GGGSGGGS/EVQLVESGGGLVQPGGSLKLSCAASGFTFNKYAINWVRQAPGKGLEWVARIRSK
YNNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLVESGGGVVRPGGSLTLSCAASGRTSRSYGMGWFRQAPGKEREFVSGISWR
GDSTGYADSVKGRFTISRDNAKNSLYLQMNSLRAEDTALYYCAAAAGSAWYGTLYEYDYWGQG
TLVTVSS/*SGGPGPAGMKGLPGS*/QTVVTQEPSLTVSPGGTVTLTCGSSTGAVTSGNYPNWVQ
QKPGQAPRGLIGDYKDDDDKGTPARFSGSLLGGKAALTLSGVQPEDEAEYYCVLWYSNRWVFG
GGTKLTVL/GGGSGGGS/EVQLVESGGGLVQPGGSLKLSCAASGFTFNKYAMNWVRQAPGKGL
EWVARIRSKYDYKDDDDKADSVKDRFTISRDDSKNTAYLQMNNLKTEDTAVYYCVRHGNFGNS
YISYWAYWGQGTLVTVSS/GGGGSGGGS/EVQLVESGGGLVQPGNSLRLSCAASGFTFSKFGM
SWVRQAPGKGLEWVSSISGSGRDTLYAESVKGRFTISRDNAKTTLYLQMNSLRPEDTAVYYCTIG
GSLSVSSQGTLVTVSS/HHHHHH (SEQ ID NO:244)

Pro256 (FL haEpCAM VIB13/haEGFR1 heterologous COBRA MMP9 linker)

QVQLVESGGGLVQPGGSLTLSCAASGTGSIFSINLMGWYRQAPGKQRELVARITSGDSTVYADS
VKGRFTISRDNSKNTLYLQMNSLRPEDTAVYYCNLLLRSSPGATTPYWGQGTLVTVSS/GGGSGG
GS/EVQLVESGGGLVQPGGSLKLSCAASGFTFNKYAINWVRQAPGKGLEWVARIRSKYNNYATY
YADQVKDRFTISRDDSKNTAYLQMNNLKTEDTAVYYCVRHANFGNSYISYWAYWGQGTLVTVS
S/GGGSGGGS/QTVVTQEPSLTVSPGGTVTLTCASSTGAVTSGNYPNWVQQKPGQAPRGLIGG
TKFLVPGTPARFSGSLLGGKAALTLSGVQPEDEAEYYCTLWYSNRWVFGGGTKLTVL/GGGSGG
GS/QVKLVESGGGVVRPGGSLTLSCAASGRTSRSYGMGWFRQAPGKEREFVSGISWRGDSTGY
ADSVKGRFTISRDNAKNSLYLQMNSLRAEDTALYYCAAAAGSAWYGTLYEYDYWGQGTLVTVSS
/*SGGPGPAGMKGLPGS*/QTVVTQEPSLTVSPGGTVTLTCGSSTGAVTSGNYPNWVQQKPGQA
PRGLIGDYKDDDDKGTPARFSGSLLGGKAALTLSGVQPEDEAEYYCVLWYSNRWVFGGGTKLTV
L/GGGSGGGS/EVQLVESGGGLVQPGGSLKLSCAASGFTFNKYAMNWVRQAPGKGLEWVARI
RSKYDYKDDDDKADSVKDRFTISRDDSKNTAYLQMNNLKTEDTAVYYCVRHGNFGNSYISYWAY
WGQGTLVTVSS/GGGGSGGGS/EVQLVESGGGLVQPGNSLRLSCAASGFTFSKFGMSWVRQA
PGKGLEWVSSISGSGRDTLYAESVKGRFTISRDNAKTTLYLQMNSLRPEDTAVYYCTIGGSLSVSS
QGTLVTVSS/HHHHHH (SEQ ID NO:245)

Figure 62G

Pro420 (FL aFOLR1 h77.2/haEGFR1 heterologous COBRA MMP9 linker)

QVQLVESGGGLVQPGGSLRLSCAASGFTVSNSVMAWYRQTPGNEREFVAIINSIGITNYADSVK
GRFTISRDNSKNTLYLQMNSLRAEDTAVYVCNRNFDRIYWGQGTLVTVSS/GGGSGGGS/EVQL
VESGGGGLVQPGGSLKLSCAASGFTFNKYAINWVRQAPGKGLEWVARIRSKYNNYATYYADQVK
DRFTISRDDSKNTAYLQMNNLKTEDTAVYYCVRHANFGNSYISYWAYWGQGTLVTVSS/GGGS
GGGS/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/GGGSGGGS/QVKL
VESGGGVVRPGGSLTLSCAASGRTSRSYGMGWFRQAPGKEREFVSGISWRGDSTGYADSVKGR
FTISRDNAKNSLYLQMNSLRAEDTALYYCAAAAGSAWYGTLYEYDYWGQGTLVTVSS/*SGGPGP
AGMKGLPGS*/QTVVTQEPSLTVSPGGTVTLTCGSSTGAVTSGNYPNWVQQKPGQAPRGLIGDY
KDDDDKGTPARFSGSLLGGKAALTLSGVQPEDEAEYYCVLWYSNRWVFGGGTKLTVL/GGGSG
GGS/EVQLVESGGGLVQPGGSLKLSCAASGFTFNKYAMNWVRQAPGKGLEWVARIRSKYDYKD
DDDKADSVKDRFTISRDDSKNTAYLQMNNLKTEDTAVYYCVRHGNFGNSYISYWAYWGQGTLV
TVSS/GGGGSGGGS/EVQLVESGGGLVQPGNSLRLSCAASGFTFSKFGMSWVRQAPGKGLEWV
SSISGSGRDTLYAESVKGRFTISRDNAKTTLYLQMNSLRPEDTAVYYCTIGGSLSVSSQGTLVTVSS/
HHHHHH (SEQ ID NO:246)

Pro421 (FL haEGFR1/aFOLR1 h77.2 heterologous COBRA MMP9 linker)

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/GG
GSGGGS/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/GGGSGGGS/QTVVTQEPSLTVSPGGTVTLTCASSTGAVTSGNYPNWVQQKPGQAPR
GLIGGTKFLVPGTPARFSGSLLGGKAALTLSGVQPEDEAEYYCTLWYSNRWVFGGGTKLTVL/GG
GSGGGS/QVQLVESGGGLVQPGGSLRLSCAASGFTVSNSVMAWYRQTPGNEREFVAIINSIGIT
NYADSVKGRFTISRDNSKNTLYLQMNSLRAEDTAVYVCNRNFDRIYWGQGTLVTVSS/*SGGPGP
AGMKGLPGS*/QTVVTQEPSLTVSPGGTVTLTCGSSTGAVTSGNYPNWVQQKPGQAPRGLIGDY
KDDDDKGTPARFSGSLLGGKAALTLSGVQPEDEAEYYCVLWYSNRWVFGGGTKLTVL/GGGSG
GGS/EVQLVESGGGLVQPGGSLKLSCAASGFTFNKYAMNWVRQAPGKGLEWVARIRSKYDYKD
DDDKADSVKDRFTISRDDSKNTAYLQMNNLKTEDTAVYYCVRHGNFGNSYISYWAYWGQGTLV
TVSS/GGGGSGGGS/EVQLVESGGGLVQPGNSLRLSCAASGFTFSKFGMSWVRQAPGKGLEWV
SSISGSGRDTLYAESVKGRFTISRDNAKTTLYLQMNSLRPEDTAVYYCTIGGSLSVSSQGTLVTVSS/
HHHHHH (SEQ ID NO:247)

Figure 62H

<u>Pro393 (Pro186 S9 linker)</u>

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/<u>G</u>
<u>GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/<u>*GARLQSAAPAGLKGAG*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:248)

<u>Pro394 (Pro186 ST14(MV) linker)</u>

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/<u>G</u>
<u>GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/<u>*GGGSFTRQARVVGGGS*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:249)

Figure 62I

Pro395 (Pro186 CathS linker)

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*GGGSARLQSAAPGGGS*/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:250)

Pro396 (Pro186 MMP9v linker)

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*GSGGPGPAGMHGLPGGS*/QTVVTQEPSLTVSPGGTVTLTCGSSTGAVTSGNYPNW
VQQKPGQAPRGLIGDYKDDDDKGTPARFSGSLLGGKAALTLSGVQPEDEAEYYCVLWYSNRWV
FGGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:251)

Figure 62J

Pro429 (Pro186 Meprin/GranzymeB linker)

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*SGGGVYADSLEDGGGS*/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:252)

Pro430 (Pro186 MMP9-2 linker)

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*SGGPGPAGLKGAPGS*/QTVVTQEPSLTVSPGGTVTLTCGSSTGAVTSGNYPNWVQ
QKPGQAPRGLIGDYKDDDDKGTPARFSGSLLGGKAALTLSGVQPEDEAEYYCVLWYSNRWVFG
GGTKLTVL/GGGSGGGS/EVQLVESGGGLVQPGGSLKLSCAASGFTFNKYAMNWVRQAPGKGL
EWVARIRSKYDYKDDDDKADSVKDRFTISRDDSKNTAYLQMNNLKTEDTAVYYCVRHGNFGNS
YISYWAYWGQGTLVTVSS/GGGGSGGGS/EVQLVESGGGLVQPGNSLRLSCAASGFTFSKFGM
SWVRQAPGKGLEWVSSISGSGRDTLYAESVKGRFTISRDNAKTTLYLQMNSLRPEDTAVYYCTIG
GSLSVSSQGTLVTVSS/HHHHHH (SEQ ID NO:253)

Figure 62K

Pro431 (Pro186 ST14(MS) linker)

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAGSAWYGTLYEYDYWGQGTQVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAGSAWYGTLYEYDYWGQG
TQVTVSS/<u>*GGGSLSGRSDNHGGGS*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:254)

Pro258 (Pro186 with a single aEGFR domain and a central aHSA domain)

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAGSAWYGTLYEYDYWGQGTLVTVSS/<u>GG
GSGGGS</u>/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/<u>GGGSGGGS</u>/QTVVTQEPSLTVSPGGTVTLTCASSTGAVTSGNYPNWVQQKPGQAPR
GLIGGTKFLVPGTPARFSGSLLGGKAALTLSGVQPEDEAEYYCTLWYSNRWVFGGGTKLTVL/<u>*SG
GPGPAGMKGLPGS*</u>/EVQLVESGGGLVQPGNSLRLCAASGFTFSKFGMSWVRQAPGKGLEWV
SSISGSGRDTLYAESVKGRFTISRDNAKTTLYLQMNSLRPEDTAVYYCTIGGSLSVSSQGTLVTVSS/
<u>GGGGSGGGS</u>/QTVVTQEPSLTVSPGGTVTLTCGSSTGAVTSGNYPNWVQQKPGQAPRGLIGDY
KDDDDKGTPARFSGSLLGGKAALTLSGVQPEDEAEYYCVLWYSNRWVFGGGTKLTVL/<u>GGGSG
GGS</u>/EVQLVESGGGLVQPGGSLKLSCAASGFTFNKYAMNWVRQAPGKGLEWVARIRSKYDYKD
DDDKADSVKDRFTISRDDSKNTAYLQMNNLKTEDTAVYYCVRHGNFGNSYISYWAYWGQGTLV
TVSS/HHHHHH (SEQ ID NO:255)

Figure 62L

Pro221

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/<u>*SGGGQNPYSAGRGGGS*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:256)

Pro222

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/<u>*SGGGQNPYSAGGGSGG*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:257)

Figure 62M

Pro223

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/SGGGRNVYSAGGGSGG/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:258)

Pro224

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/SGGGQNTWSAGKGGGS/QTVVTQEPSLTVSPGGTVTLTCGSSTGAVTSGNYPNW
VQQKPGQAPRGLIGDYKDDDDKGTPARFSGSLLGGKAALTLSGVQPEDEAEYYCVLWYSNRWV
FGGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:259)

Figure 62N

Pro254

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/<u>GG
GSGGGS</u>/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/<u>GGGSGGGS</u>/QTVVTQEPSLTVSPGGTVTLTCASSTGAVTSGNYPNWVQQKPGQAPR
GLIGGTKFLVPGTPARFSGSLLGGKAALTLSGVQPEDEAEYYCTLWYSNRWVFGGGTKLTVL/<u>GG
GSGGGS</u>/EVQLVESGGGLVQPGGSLRLSCAASGRTFSSYAMGWFRQAPGKEREFVVAINWSSG
STYYADSVKGRFTISRDNSKNTLYLQMNSLRAEDTAVYYCAAGYQINSGNYNFKDYEYDYWGQG
TLVTVSS/*SGGPGPAGMKGLPGS*/QTVVTQEPSLTVSPGGTVTLTCGSSTGAVTSGNYPNWVQ
QKPGQAPRGLIGDYKDDDDKGTPARFSGSLLGGKAALTLSGVQPEDEAEYYCVLWYSNRWVFG
GGTKLTVL/<u>GGGSGGGS</u>/EVQLVESGGGLVQPGGSLKLSCAASGFTFNKYAMNWVRQAPGKGL
EWVARIRSKYDYKDDDDKADSVKDRFTISRDDSKNTAYLQMNNLKTEDTAVYYCVRHGNFGNS
YISYWAYWGQGTLVTVSS/<u>GGGGSGGGS</u>/EVQLVESGGGLVQPGNSLRLSCAASGFTFSKFGM
SWVRQAPGKGLEWVSSISGSGRDTLYAESVKGRFTISRDNAKTTLYLQMNSLRPEDTAVYYCTIG
GSLSVSSQGTLVTVSS/HHHHHH (SEQ ID NO:260)

Pro255

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/<u>GG
GSGGGS</u>/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/<u>GGGSGGGS</u>/QTVVTQEPSLTVSPGGTVTLTCASSTGAVTSGNYPNWVQQKPGQAPR
GLIGGTKFLVPGTPARFSGSLLGGKAALTLSGVQPEDEAEYYCTLWYSNRWVFGGGTKLTVL/<u>GG
GSGGGS</u>/QVQLVESGGGLVQPGGSLTLSCAASGTGSIFSINLMGWYRQAPGKQRELVARITSGD
STVYADSVKGRFTISRDNSKNTLYLQMNSLRPEDTAVYYCNLLRSSPGATTPYWGQGTLVTVSS/
*SGGPGPAGMKGLPGS*/QTVVTQEPSLTVSPGGTVTLTCGSSTGAVTSGNYPNWVQQKPGQAP
RGLIGDYKDDDDKGTPARFSGSLLGGKAALTLSGVQPEDEAEYYCVLWYSNRWVFGGGTKLTVL
/<u>GGGSGGGS</u>/EVQLVESGGGLVQPGGSLKLSCAASGFTFNKYAMNWVRQAPGKGLEWVARIR
SKYDYKDDDDKADSVKDRFTISRDDSKNTAYLQMNNLKTEDTAVYYCVRHGNFGNSYISYWAY
WGQGTLVTVSS/<u>GGGGSGGGS</u>/EVQLVESGGGLVQPGNSLRLSCAASGFTFSKFGMSWVRQA
PGKGLEWVSSISGSGRDTLYAESVKGRFTISRDNAKTTLYLQMNSLRPEDTAVYYCTIGGSLSVSS
QGTLVTVSS/HHHHHH (SEQ ID NO:261)

Figure 62O

Pro262

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGGSGGGGSGGGGS/QTVVTQEPSLTVSPGGTVTLTCASSTGAVTSGNYPNWV
QQKPGQAPRGLIGGTKFLVPGTPARFSGSLLGGKAALTLSGVQPEDEAEYYCTLWYSNRWVFGG
GTKLTVL/GGGSGGGS/QVKLEESGGGSVQTGGSLRLTCAASGRTSRSYGMGWFRQAPGKERE
FVSGISWRGDSTGYADSVKGRFTISRDNAKNTVDLQMNSLKPEDTAIYYCAAAAGSAWYGTLYE
YDYWGQGTQVTVSS/*SGGPGPAGMKGLPGS*/QTVVTQEPSLTVSPGGTVTLTCGSSTGAVTSG
NYPNWVQQKPGQAPRGLIGDYKDDDDKGTPARFSGSLLGGKAALTLSGVQPEDEAEYYCVLWY
SNRWVFGGGTKLTVL/GGGSGGGS/EVQLVESGGGLVQPGGSLKLSCAASGFTFNKYAMNWV
RQAPGKGLEWVARIRSKYDYKDDDDKADSVKDRFTISRDDSKNTAYLQMNNLKTEDTAVYYCV
RHGNFGNSYISYWAYWGQGTLVTVSS/GGGGSGGGS/EVQLVESGGGLVQPGNSLRLSCAASG
FTFSKFGMSWVRQAPGKGLEWVSSISGSSRDTLYAESVKGRFTISRDNAKTTLYLQMNSLRPEDT
AVYYCTIGGSLSVSSQGTLVTVSS/HHHHHH (SEQ ID NO:262)

Pro356

EVQLVESGGGLVQPGGSLRLSCAASGRTFSSYAMGWFRQAPGKEREFVVAINWSSGSTYYADS
VKGRFTISRDNSKNTLYLQMNSLRAEDTAVYYCAAGYQINSGNYNFKDYEYDYWGQGTLVTVSS
/GGGSGGGS/EVQLVESGGGLVQPGGSLKLSCAASGFTFNKYAINWVRQAPGKGLEWVARIRSK
YNNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
*SGGPGPAGMKGLPGS*/EVQLVESGGGLVQPGNSLRLSCAASGFTFSKFGMSWVRQAPGKGLE
WVSSISGSGRDTLYAESVKGRFTISRDNAKTTLYLQMNSLRPEDTAVYYCTIGGSLSVSSQGTLVT
VSS/GGGGSGGGS/QTVVTQEPSLTVSPGGTVTLTCGSSTGAVTSGNYPNWVQQKPGQAPRGL
IGDYKDDDDKGTPARFSGSLLGGKAALTLSGVQPEDEAEYYCVLWYSNRWVFGGGTKLTVL/GG
GSGGGS/EVQLVESGGGLVQPGGSLKLSCAASGFTFNKYAMNWVRQAPGKGLEWVARIRSKY
DYKDDDDKADSVKDRFTISRDDSKNTAYLQMNNLKTEDTAVYYCVRHGNFGNSYISYWAYWG
QGTLVTVSS/HHHHHH (SEQ ID NO:263)

Figure 62P

Pro359

QVQLQESGGGLVQPGGSLRLSCAPSRRTFHTYHMGWFRQAPGKEREFVAVINWSGGSTVYAD
SVKGRFTISRDNSKNTLYLQMNSLRAEDTAVYYCAAGGATTQRATEASYDYWGQGTLVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
*<u>SGGPGPAGMKGLPGS</u>*/EVQLVESGGGLVQPGNSLRLSCAASGFTFSKFGMSWVRQAPGKGLE
WVSSISGSGRDTLYAESVKGRFTISRDNAKTTLYLQMNSLRPEDTAVYYCTIGGSLSVSSQGTLVT
VSS/<u>GGGGSGGGS</u>/QTVVTQEPSLTVSPGGTVTLTCGSSTGAVTSGNYPNWVQQKPGQAPRGL
IGDYKDDDDKGTPARFSGSLLGGKAALTLSGVQPEDEAEYYCVLWYSNRWVFGGGTKLTVL/<u>GG
GSGGGS</u>/EVQLVESGGGLVQPGGSLKLSCAASGFTFNKYAMNWVRQAPGKGLEWVARIRSKY
DYKDDDDKADSVKDRFTISRDDSKNTAYLQMNNLKTEDTAVYYCVRHGNFGNSYISYWAYWG
QGTLVTVSS/HHHHHH (SEQ ID NO:264)

Pro364

QVQLVESGGGLVQPGGSLRLSCAAPGNTFSISAMGWYRQAPGKQREWVAVTHSDYSTNYADS
VKGRFTISRDNSKNTLYLQMNSLRAEDTAVYYCKHYGIDYWGQGTLVTVSS/<u>GGGSGGGS</u>/EVQ
LVESGGGLVQPGGSLKLSCAASGFTFNKYAINWVRQAPGKGLEWVARIRSKYNNYATYYADQVK
DRFTISRDDSKNTAYLQMNNLKTEDTAVYYCVRHANFGNSYISYWAYWGQGTLVTVSS/<u>GGGS
GGGS</u>/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/*<u>SGGPGPAGMKGL
PGS</u>*/EVQLVESGGGLVQPGNSLRLSCAASGFTFSKFGMSWVRQAPGKGLEWVSSISGSGRDTLY
AESVKGRFTISRDNAKTTLYLQMNSLRPEDTAVYYCTIGGSLSVSSQGTLVTVSS/<u>GGGGSGGGS</u>/
QTVVTQEPSLTVSPGGTVTLTCGSSTGAVTSGNYPNWVQQKPGQAPRGLIGDYKDDDDKGTPA
RFSGSLLGGKAALTLSGVQPEDEAEYYCVLWYSNRWVFGGGTKLTVL/<u>GGGSGGGS</u>/EVQLVES
GGGLVQPGGSLKLSCAASGFTFNKYAMNWVRQAPGKGLEWVARIRSKYDYKDDDDKADSVKD
RFTISRDDSKNTAYLQMNNLKTEDTAVYYCVRHGNFGNSYISYWAYWGQGTLVTVSS/HHHHH
H (SEQ ID NO:265)

Figure 62Q

Pro388

QVQLVESGGGLVQPGGSLRLSCAASGFTVSNSVMAWYRQTPGNEREFVAIINSIGITNYADSVK
GRFTISRDNSKNTLYLQMNSLRAEDTAVYYCNRNFDRIYWGQGTLVTVSS/<u>GGGSGGGS</u>/EVQL
VESGGGLVQPGGSLKLSCAASGFTFNKYAINWVRQAPGKGLEWVARIRSKYNNYATYYADQVK
DRFTISRDDSKNTAYLQMNNLKTEDTAVYYCVRHANFGNSYISYWAYWGQGTLVTVSS/<u>GGGS
GGGS</u>/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/<u>*SGGPGPAGMKGL
PGS*</u>/EVQLVESGGGLVQPGNSLRLSCAASGFTFSKFGMSWVRQAPGKGLEWVSSISGSGRDTLY
AESVKGRFTISRDNAKTTLYLQMNSLRPEDTAVYYCTIGGSLSVSSQGTLVTVSS/<u>GGGGSGGGS</u>/
QTVVTQEPSLTVSPGGTVTLTCGSSTGAVTSGNYPNWVQQKPGQAPRGLIGDYKDDDDKGTPA
RFSGSLLGGKAALTLSGVQPEDEAEYYCVLWYSNRWVFGGGTKLTVL/<u>GGGSGGGS</u>/EVQLVES
GGGLVQPGGSLKLSCAASGFTFNKYAMNWVRQAPGKGLEWVARIRSKYDYKDDDDKADSVKD
RFTISRDDSKNTAYLQMNNLKTEDTAVYYCVRHGNFGNSYISYWAYWGQGTLVTVSS/HHHHH
H (SEQ ID NO:266)

Pro429

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAGSAWYGTLYEYDYWGQGTQVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAGSAWYGTLYEYDYWGQG
TQVTVSS/<u>*SGGGVYADSLEDGGGS*</u>/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/<u>GGGSGGGS</u>/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/<u>GGGGSGGGS</u>/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:267)

Figure 62R

Pro430

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*SGGPGPAGLKGAPGS*/QTVVTQEPSLTVSPGGTVTLTCGSSTGAVTSGNYPNWVQ
QKPGQAPRGLIGDYKDDDDKGTPARFSGSLLGGKAALTLSGVQPEDEAEYYCVLWYSNRWVFG
GGTKLTVL/GGGSGGGS/EVQLVESGGGLVQPGGSLKLSCAASGFTFNKYAMNWVRQAPGKGL
EWVARIRSKYDYKDDDDKADSVKDRFTISRDDSKNTAYLQMNNLKTEDTAVYYCVRHGNFGNS
YISYWAYWGQGTLVTVSS/GGGGSGGGS/EVQLVESGGGLVQPGNSLRLSCAASGFTFSKFGM
SWVRQAPGKGLEWVSSISGSGRDTLYAESVKGRFTISRDNAKTTLYLQMNSLRPEDTAVYYCTIG
GSLSVSSQGTLVTVSS/HHHHHH (SEQ ID NO:268)

Pro431

QVKLEESGGGSVQTGGSLRLTCAASGRTSRSYGMGWFRQAPGKEREFVSGISWRGDSTGYADS
VKGRFTISRDNAKNTVDLQMNSLKPEDTAIYYCAAAAGSAWYGTLYEYDYWGQGTQVTVSS/G
GGSGGGS/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
GGGSGGGS/QVKLEESGGGSVQTGGSLRLTCAASGRTSRSYGMGWFRQAPGKEREFVSGISWR
GDSTGYADSVKGRFTISRDNAKNTVDLQMNSLKPEDTAIYYCAAAAGSAWYGTLYEYDYWGQG
TQVTVSS/*GGGSLSGRSDNHGGGS*/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVF
GGGTKLTVL/GGGSGGGS/EVQLVESGGGLVQPGGSLKLSCAASGFTFNKYAMNWVRQAPGK
GLEWVARIRSKYDYKDDDDKADSVKDRFTISRDDSKNTAYLQMNNLKTEDTAVYYCVRHGNFG
NSYISYWAYWGQGTLVTVSS/GGGGSGGGS/EVQLVESGGGLVQPGNSLRLSCAASGFTFSKFG
MSWVRQAPGKGLEWVSSISGSGRDTLYAESVKGRFTISRDNAKTTLYLQMNSLRPEDTAVYYCTI
GGSLSVSSQGTLVTVSS/HHHHHH (SEQ ID NO:269)

Figure 62S

Pro432

QVQLVESGGGLVQPGGSLTLSCAASGTGSIFSINLMGWYRQAPGKQRELVARITSGDSTVYADS
VKGRFTISRDNSKNTLYLQMNSLRPEDTAVYYCNLLRSSPGATTPYWGQGTLVTVSS/<u>GGGSGG</u>
<u>GS</u>/EVQLVESGGGLVQPGGSLKLSCAASGFTFNKYAINWVRQAPGKGLEWVARIRSKYNNYATY
YADQVKDRFTISRDDSKNTAYLQMNNLKTEDTAVYYCVRHANFGNSYISYWAYWGQGTLVTVS
S/<u>GGGSGGGS</u>/QTVVTQEPSLTVSPGGTVTLTCASSTGAVTSGNYPNWVQQKPGQAPRGLIGG
TKFLVPGTPARFSGSLLGGKAALTLSGVQPEDEAEYYCTLWYSNRWVFGGGTKLTVL/<u>GGGSGG</u>
<u>GS</u>/EVQLVESGGGLVQPGGSLRLSCAASGRTFSSYAMGWFRQAPGKEREFVVAINWSSGSTYYA
DSVKGRFTISRDNSKNTLYLQMNSLRAEDTAVYYCAAGYQINSGNYNFKDYEYDYWGQGTLVTV
SS/<u>*SGGPGPAGMKGLPGS*</u>/QTVVTQEPSLTVSPGGTVTLTCGSSTGAVTSGNYPNWVQQKPGQ
APRGLIGDYKDDDDKGTPARFSGSLLGGKAALTLSGVQPEDEAEYYCVLWYSNRWVFGGGTKLT
VL/<u>GGGSGGGS</u>/EVQLVESGGGLVQPGGSLKLSCAASGFTFNKYAMNWVRQAPGKGLEWVAR
IRSKYDYKDDDDKADSVKDRFTISRDDSKNTAYLQMNNLKTEDTAVYYCVRHGNFGNSYISYWA
YWGQGTLVTVSS/<u>GGGGSGGGS</u>/EVQLVESGGGLVQPGNSLRLSCAASGFTFSKFGMSWVRQ
APGKGLEWVSSISGSGRDTLYAESVKGRFTISRDNAKTTLYLQMNSLRPEDTAVYYCTIGGSLSVS
SQGTLVTVSS/HHHHHH (SEQ ID NO:270)

Pro448

QVQLVESGGGLVQPGGSLRLSCAASGFTVSNSVMAWYRQTPGNEREFVAIINSIGITNYADSVK
GRFTISRDNSKNTLYLQMNSLRAEDTAVYYCNRNFDRIYWGQGTLVTVSS/<u>GGGGSGGGS</u>/QV
KLVESGGGVVRPGGSLTLSCAASGRTSRSYGMGWFRQAPGKEREFVSGISWRGDSTGYADSVK
GRFTISRDNAKNSLYLQMNSLRAEDTALYYCAAAAGSAWYGTLYEYDYWGQGTLVTVSS/<u>GGG</u>
<u>GSGGGS</u>/EVQLVESGGGLVQPGGSLKLSCAASGFTFNKYAINWVRQAPGKGLEWVARIRSKYN
NYATYYADQVKDRFTISRDDSKNTAYLQMNNLKTEDTAVYYCVRHANFGNSYISYWAYWGQGT
LVTVSS/<u>*SGGPGPAGMKGLPGS*</u>/QTVVTQEPSLTVSPGGTVTLTCGSSTGAVTSGNYPNWVQQ
KPGQAPRGLIGDYKDDDDKGTPARFSGSLLGGKAALTLSGVQPEDEAEYYCVLWYSNRWVFGG
GTKLTVL/<u>GGGGSGGGS</u>/EVQLVESGGGLVQPGNSLRLSCAASGFTFSKFGMSWVRQAPGKGL
EWVSSISGSGRDTLYAESVKGRFTISRDNAKTTLYLQMNSLRPEDTAVYYCTIGGSLSVSSQGTLVT
VSS/HHHHHH (SEQ ID NO:271)

Figure 62T

Pro449

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/*GG
GGSGGGS*/QVQLVESGGGLVQPGGSLRLSCAASGFTVSNSVMAWYRQTPGNEREFVAIINSIGI
TNYADSVKGRFTISRDNSKNTLYLQMNSLRAEDTAVYVCNRNFDRIYWGQGTLVTVSS/*GGGGS
GGGS*/EVQLVESGGGLVQPGGSLKLSCAASGFTFNKYAINWVRQAPGKGLEWVARIRSKYNNY
ATYYADQVKDRFTISRDDSKNTAYLQMNNLKTEDTAVYYCVRHANFGNSYISYWAYWGQGTLV
TVSS/*SGGPGPAGMKGLPGS*/QTVVTQEPSLTVSPGGTVTLTCGSSTGAVTSGNYPNWVQQKP
GQAPRGLIGDYKDDDDKGTPARFSGSLLGGKAALTLSGVQPEDEAEYYCVLWYSNRWVFGGGT
KLTVL/*GGGGSGGGS*/EVQLVESGGGLVQPGNSLRLSCAASGFTFSKFGMSWVRQAPGKGLEW
VSSISGSGRDTLYAESVKGRFTISRDNAKTTLYLQMNSLRPEDTAVYYCTIGGSLSVSSQGTLVTVS
S/HHHHHH (SEQ ID NO:272)

Pro450

QVQLVESGGGLVQPGGSLRLSCAASGFTVSNSVMAWYRQTPGNEREFVAIINSIGITNYADSVK
GRFTISRDNSKNTLYLQMNSLRAEDTAVYVCNRNFDRIYWGQGTLVTVSS/*GGGGSGGGS*/QV
KLVESGGGVVRPGGSLTLSCAASGRTSRSYGMGWFRQAPGKEREFVSGISWRGDSTGYADSVK
GRFTISRDNAKNSLYLQMNSLRAEDTALYYCAAAAGSAWYGTLYEYDYWGQGTLVTVSS/*GGG
GSGGGS*/QTVVTQEPSLTVSPGGTVTLTCASSTGAVTSGNYPNWVQQKPGQAPRGLIGGTKFLV
PGTPARFSGSLLGGKAALTLSGVQPEDEAEYYCTLWYSNRWVFGGGTKLTVL/*SGGPGPAGMK
GLPGS*/EVQLVESGGGLVQPGGSLKLSCAASGFTFNKYAMNWVRQAPGKGLEWVARIRSKYDY
KDDDDKADSVKDRFTISRDDSKNTAYLQMNNLKTEDTAVYYCVRHGNFGNSYISYWAYWGQG
TLVTVSS/*GGGGSGGGS*/EVQLVESGGGLVQPGNSLRLSCAASGFTFSKFGMSWVRQAPGKGLE
WVSSISGSGRDTLYAESVKGRFTISRDNAKTTLYLQMNSLRPEDTAVYYCTIGGSLSVSSQGTLVT
VSS/HHHHHH (SEQ ID NO:273)

Figure 62U

Pro451

QVKLVESGGGVVRPGGSLTLSCAASGRTSRSYGMGWFRQAPGKEREFVSGISWRGDSTGYADS
VKGRFTISRDNAKNSLYLQMNSLRAEDTALYYCAAAAGSAWYGTLYEYDYWGQGTLVTVSS/*GG*
*GGSGGGS*/QVQLVESGGGLVQPGGSLRLSCAASGFTVSNSVMAWYRQTPGNEREFVAIINSIGI
TNYADSVKGRFTISRDNSKNTLYLQMNSLRAEDTAVYVCNRNFDRIYWGQGTLVTVSS/*GGGGS*
*GGGS*/QTVVTQEPSLTVSPGGTVTLTCASSTGAVTSGNYPNWVQQKPGQAPRGLIGGTKFLVPG
TPARFSGSLLGGKAALTLSGVQPEDEAEYYCTLWYSNRWVFGGGTKLTVL/*SGGPGPAGMKGL*
*PGS*/EVQLVESGGGLVQPGGSLKLSCAASGFTFNKYAMNWVRQAPGKGLEWVARIRSKYDYKD
DDDKADSVKDRFTISRDDSKNTAYLQMNNLKTEDTAVYYCVRHGNFGNSYISYWAYWGQGTLV
TVSS/*GGGGSGGGS*/EVQLVESGGGLVQPGNSLRLSCAASGFTFSKFGMSWVRQAPGKGLEWV
SSISGSGRDTLYAESVKGRFTISRDNAKTTLYLQMNSLRPEDTAVYYCTIGGSLSVSSQGTLVTVSS/
HHHHHH (SEQ ID NO:274)

Pro479

QVQLQESGGGLVQPGGSLRLSCAPSRRTFHTYHMGWFRQAPGKEREFVAVINWSGGSTVYAD
SVKGRFTISRDNSKNTLYLQMNSLRAEDTAVYYCAAGGATTQRATEASYDYWGQGTLVTVSS/*G*
*GGSGGGS*/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/*GGGSGGGS*/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
*GGGSGGGS*/QVQLQESGGGLVQPGGSLRLSCEASPRTFSTYSMAWFRQAPGKERSFVAAINWS
GGNTSYADSVKGRFTISRDNSKNTLYLQMNSLRAEDTAVYYCAAGGVLAHHNYEYDYWGQGTL
VTVSS/*SGGPGPAGMKGLPGS*/QTVVTQEPSLTVSPGGTVTLTCGSSTGAVTSGNYPNWVQQK
PGQAPRGLIGDYKDDDDKGTPARFSGSLLGGKAALTLSGVQPEDEAEYYCVLWYSNRWVFGGG
TKLTVL/*GGGSGGGS*/EVQLVESGGGLVQPGGSLKLSCAASGFTFNKYAMNWVRQAPGKGLE
WVARIRSKYDYKDDDDKADSVKDRFTISRDDSKNTAYLQMNNLKTEDTAVYYCVRHGNFGNSYI
SYWAYWGQGTLVTVSS/*GGGGSGGGS*/EVQLVESGGGLVQPGNSLRLSCAASGFTFSKFGMS
WVRQAPGKGLEWVSSISGSGRDTLYAESVKGRFTISRDNAKTTLYLQMNSLRPEDTAVYYCTIGG
SLSVSSQGTLVTVSS/HHHHHH (SEQ ID NO:275)

Figure 62V

Pro480

QVQLQESGGGLVQPGGSLRLSCEASPRTFSTYSMAWFRQAPGKERSFVAAINWSGGNTSYADS
VKGRFTISRDNSKNTLYLQMNSLRAEDTAVYYCAAGGVLAHHNYEYDYWGQGTLVTVSS/<u>GGG
SGGGS</u>/EVQLVESGGGLVQPGGSLKLSCAASGFTFNKYAINWVRQAPGKGLEWVARIRSKYNNY
ATYYADQVKDRFTISRDDSKNTAYLQMNNLKTEDTAVYYCVRHANFGNSYISYWAYWGQGTLV
TVSS/<u>GGGSGGGS</u>/QTVVTQEPSLTVSPGGTVTLTCASSTGAVTSGNYPNWVQQKPGQAPRGLI
GGTKFLVPGTPARFSGSLLGGKAALTLSGVQPEDEAEYYCTLWYSNRWVFGGGTKLTVL/<u>GGGS
GGGS</u>/QVQLQESGGGLVQPGGSLRLSCAPSRRTFHTYHMGWFRQAPGKEREFVAVINWSGGS
TVYADSVKGRFTISRDNSKNTLYLQMNSLRAEDTAVYYCAAGGATTQRATEASYDYWGQGTLVT
VSS/<u>*SGGPGPAGMKGLPGS*</u>/QTVVTQEPSLTVSPGGTVTLTCGSSTGAVTSGNYPNWVQQKPG
QAPRGLIGDYKDDDDKGTPARFSGSLLGGKAALTLSGVQPEDEAEYYCVLWYSNRWVFGGGTK
LTVL/<u>GGGSGGGS</u>/EVQLVESGGGLVQPGGSLKLSCAASGFTFNKYAMNWVRQAPGKGLEWV
ARIRSKYDYKDDDDKADSVKDRFTISRDDSKNTAYLQMNNLKTEDTAVYYCVRHGNFGNSYISY
WAYWGQGTLVTVSS/<u>GGGGSGGGS</u>/EVQLVESGGGLVQPGNSLRLSCAASGFTFSKFGMSWV
RQAPGKGLEWVSSISGSGRDTLYAESVKGRFTISRDNAKTTLYLQMNSLRPEDTAVYYCTIGGSLS
VSSQGTLVTVSS/HHHHHH (SEQ ID NO:276)

Pro495

QVQLQESGGGLVQPGGSLRLSCAPSRRTFHTYHMGWFRQAPGKEREFVAVINWSGGSTVYAD
SVKGRFTISRDNSKNTLYLQMNSLRAEDTAVYYCAAGGATTQRATEASYDYWGQGTLVTVSS/<u>G
GGSGGGS</u>/EVQLVESGGGLVQPGGSLKLSCAASGFTFNKYAINWVRQAPGKGLEWVARIRSKY
NNYATYYADQVKDRFTISRDDSKNTAYLQMNNLKTEDTAVYYCVRHANFGNSYISYWAYWGQ
GTLVTVSS/<u>GGGSGGGS</u>/QTVVTQEPSLTVSPGGTVTLTCASSTGAVTSGNYPNWVQQKPGQA
PRGLIGGTKFLVPGTPARFSGSLLGGKAALTLSGVQPEDEAEYYCTLWYSNRWVFGGGTKLTVL/
<u>GGGSGGGS</u>/QVQLQESGGGLVQPGGSLRLSCAPSRRTFHTYHMGWFRQAPGKEREFVAVINW
SGGSTVYADSVKGRFTISRDNSKNTLYLQMNSLRAEDTAVYYCAAGGATTQRATEASYDYWGQ
GTLVTVSS/<u>*SGGPGPAGMKGLPGS*</u>/QTVVTQEPSLTVSPGGTVTLTCGSSTGAVTSGNYPNWV
QQKPGQAPRGLIGGTKDDAPGTPARFSGSLLGGKAALTLSGVQPEDEAEYYCVLWYSNRWVFG
GGTKLTVL/<u>GGGSGGGS</u>/EVQLVESGGGLVQPGGSLKLSCAASGFTFNKHAMNWVRQAPGKG
LEWVARIRSKYNNYATAYADSVKDRFTISRDDSKNTAYLQMNNLKTEDTAVYYCVRHGNFGNSY
ISYWAYWGQGTLVTVSS/<u>GGGGSGGGS</u>/EVQLVESGGGLVQPGNSLRLSCAASGFTFSKFGMS
WVRQAPGKGLEWVSSISGSGRDTLYAESVKGRFTISRDNAKTTLYLQMNSLRPEDTAVYYCTIGG
SLSVSSQGTLVTVSS/HHHHHH (SEQ ID NO:277)

FIG. 63A

Pro601 aB7H3 hF7 sdAb – aCD3 Vh (2B2) – NCL-8 – aCD3Vl (2B2) - aB7H3 hF7 sdAb
– MMP9-15 - aCD3Vli2 –NCL-8 - aCD3Vhi2 – aHSA (10GE) - His6
QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCA<u>AGGATTQRATEASYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGS
LRLSCAPS<u>RRTFHTYHMG</u>WFRQAPGKEREFVA<u>VINWSGGSTVYADSVKG</u>RFTISRDNSKNTLYLQMNSLRAEDTAVYYCA<u>A</u>
<u>GGATTQRATEASYDY</u>WGQGTLVTVSS/<u>SGGPGPAGMKGLPGS</u>/QTVVTQEPSLTVSPGGTVTLTC<u>SSTGAVTSGNYPN</u>W
VQQKPGQAPRGLIG<u>GTKDDAP</u>GTPARFSGSLLGGKAALTLSGVQPEDEAEYYC<u>VLWYSNRWV</u>FGGGTKLTVL/<u>GGGSGGGS</u>
/EVQLVESGGGLVQPGGSLKLSCAAS<u>GFTFNKHAMN</u>WVRQAPGKGLEWVA<u>RIRSKYNNYATAYADSVKD</u>RFTISRDDSKNT
AYLQMNNLKTEDTAVYYCVR<u>HGNFGNSYISYWAY</u>WGQGTLVTVSS/<u>GGGGSGGGS</u>/EVQLVESGGGLVQPGNSLRLSCAAS
<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>VSSQG
TLVTVSS/HHHHHH (SEQ ID NO:278)

Pro602 aB7H3 hF12 sdAb – aCD3 Vh (2B2) – NCL-8 – aCD3Vl (2B2) - aB7H3 hF12 sdAb
– MMP9-15 - aCD3Vli2 –NCL-8 - aCD3Vhi2 – aHSA (10GE) - His6
QVQLQESGGGLVQPGGSLRLSCEAS<u>PRTFSTYSMA</u>WFRQAPGKERSFVA<u>AINWSGGNTSYADSVKG</u>RFTISRDNSKNTLYLQ
MNSLRAEDTAVYYCA<u>AGGVLAHHNYEYDY</u>WGQGTLVTVSS/<u>GGGSGGGS</u>/EVQLVESGGGLVQPGGSLKLSCAAS<u>GFTFNK</u>
<u>YAIN</u>WVRQAPGKGLEWVA<u>RIRSKYNNYATYYADQVKD</u>RFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGNTSYADSVKG</u>RFTISRDNSKNTLYLQMNSLRAEDTAVYYCA<u>AGG</u>
<u>VLAHHNYEYDY</u>WGQGTLVTVSS/<u>SGGPGPAGMKGLPGS</u>/QTVVTQEPSLTVSPGGTVTLTC<u>SSTGAVTSGNYPN</u>WVQQK
PGQAPRGLIG<u>GTKDDAP</u>GTPARFSGSLLGGKAALTLSGVQPEDEAEYYC<u>VLWYSNRWV</u>FGGGTKLTVL/<u>GGGSGGGS</u>/EVQL
VESGGGLVQPGGSLKLSCAAS<u>GFTFNKHAMN</u>WVRQAPGKGLEWVA<u>RIRSKYNNYATAYADSVKD</u>RFTISRDDSKNTAYLQ
MNNLKTEDTAVYYCVR<u>HGNFGNSYISYWAY</u>WGQGTLVTVSS/<u>GGGGSGGGS</u>/EVQLVESGGGLVQPGNSLRLSCAAS<u>GFTF</u>
<u>SKFGMS</u>WVRQAPGKGLEWVS<u>SISGSGRDTLYAESVKG</u>RFTISRDNAKTTLYLQMNSLRPEDTAVYYCT<u>IGGSLS</u>VSSQGTLVT
VSS/HHHHHH (SEQ ID NO:279)

FIG. 63B

<u>V3</u> a87H3 hF7 sdAb – aCD3 Vh (2B2) – NCL-8 – aCD3Vl (2B2) – a87H3 hF12 sdAb

– MMP9-15 - aCD3Vli2 –NCL-8 - aCD3Vhi2 – aHSA (10GE) - His6

QVQLQESGGGLVQPGGSLRLSCAPS<u>RRTFHTYHMG</u>WFRQAPGKEREFVA<u>INWSGGSTVYADSVKG</u>RFTISRDNSKNTLYL
QMNSLRAEDTAVYYCA<u>AGGATTQRATEASYDY</u>WGQGTLVTVSS/*GGGSGGGS*/EVQLVESGGGLVQPGGSLKLSCAAS<u>GFT
FNKYAIN</u>WVRQAPGKGLEWVA<u>RIRSKYNNYATYYADQVKD</u>RFTISRDDSKNTAYLQMNNLKTEDTAVYYCVR<u>HANFGNSYI
SYWAY</u>WGQGTLVTVSS/*GGGSGGGS*/QTVVTQEPSLTVSPGGTVTLTC<u>ASSTGAVTSGNYPN</u>WVQQKPGQAPRGLIG<u>GTK
FLVP</u>GTPARFSGSLLGGKAALTLSGVQPEDEAEYYC<u>TLWYSNRWV</u>FGGGTKLTVL/*GGGSGGGS*/QVQLQESGGGLVQPGGS
LRLSCEAS<u>PRTFSTYSMAW</u>FRQAPGKERSFVA<u>INWSGGNTSYADSVKG</u>RFTISRDNSKNTLYLQMNSLRAEDTAVYYCA<u>AG
GVLAHHNYEYDY</u>WGQGTLVTVSS/*SGGPGPAGMKGLPGS*/QTVVTQEPSLTVSPGGTVTLTC<u>GSSTGAVTSGNYPN</u>WVQQ
KPGQAPRGLIG<u>GTKDDAP</u>GTPARFSGSLLGGKAALTLSGVQPEDEAEYYC<u>VLWYSNRWV</u>FGGGTKLTVL/*GGGSGGGS*/EVQ
LVESGGGLVQPGGSLKLSCAAS<u>GFTFNKHAMN</u>WVRQAPGKGLEWVA<u>RIRSKYNNYATAYADSVKD</u>RFTISRDDSKNTAYLQ
MNNLKTEDTAVYYCVR<u>HGNFGNSYISYWAY</u>WGQGTLVTVSS/*GGGGSGGGS*/EVQLVESGGGLVQPGNSLRLSCAAS<u>GFTF
SKFGMS</u>WVRQAPGKGLEWVS<u>SISGSGRDTLYAESVKG</u>RFTISRDNAKTTLYLQMNSLRPEDTAVYYCT<u>IGGSLS</u>VSSQGTLVT
VSS/HHHHHH (SEQ ID NO:280)

<u>V4</u> a87H3 hF12 sdAb – aCD3 Vh (2B2) – NCL-8 – aCD3Vl (2B2) – a87H3 hF7 sdAb

– MMP9-15 - aCD3Vli2 –NCL-8 - aCD3Vhi2 – aHSA (10GE) - His6

QVQLQESGGGLVQPGGSLRLSCEAS<u>PRTFSTYSMAW</u>FRQAPGKERSFVA<u>AINWSGGNTSYADSVKG</u>RFTISRDNSKNTLYLQ
MNSLRAEDTAVYYCA<u>AGGVLAHHNYEYDY</u>WGQGTLVTVSS/*GGGSGGGS*/EVQLVESGGGLVQPGGSLKLSCAAS<u>GFTFNK
YAIN</u>WVRQAPGKGLEWVA<u>RIRSKYNNYATYYADQVKD</u>RFTISRDDSKNTAYLQMNNLKTEDTAVYYCVR<u>HANFGNSYISY
WAY</u>WGQGTLVTVSS/*GGGSGGGS*/QTVVTQEPSLTVSPGGTVTLTC<u>ASSTGAVTSGNYPN</u>WVQQKPGQAPRGLIG<u>GTKFL
VP</u>GTPARFSGSLLGGKAALTLSGVQPEDEAEYY<u>CTLWYSNRWV</u>FGGGTKLTVL/*GGGSGGGS*/QVQLQESGGGLVQPGGSLR
LSCAPS<u>RRTFHTYHMG</u>WFRQAPGKEREFVA<u>INWSGGSTVYADSVKG</u>RFTISRDNSKNTLYLQMNSLRAEDTAVYYCA<u>AGG
ATTQRATEASYDY</u>WGQGTLVTVSS/*SGGPGPAGMKGLPGS*/QTVVTQEPSLTVSPGGTVTLTC<u>GSSTGAVTSGNYPN</u>WVQ
QKPGQAPRGLIG<u>GTKDDAP</u>GTPARFSGSLLGGKAALTLSGVQPEDEAEYYC<u>VLWYSNRWV</u>FGGGTKLTVL/*GGGSGGGS*/EV
QLVESGGGLVQPGGSLKLSCAAS<u>GFTFNKHAMN</u>WVRQAPGKGLEWVA<u>RIRSKYNNYATAYADSVKD</u>RFTISRDDSKNTAYL
QMNNLKTEDTAVYYCVR<u>HGNFGNSYISYWAY</u>WGQGTLVTVSS/*GGGSGGGS*/EVQLVESGGGLVQPGNSLRLSCAAS<u>GFT
FSKFGMS</u>WVRQAPGKGLEWVS<u>SISGSGRDTLYAESVKG</u>RFTISRDNAKTTLYLQMNSLRPEDTAVYYCT<u>IGGSLS</u>VSSQGTLV
TVSS/HHHHHH (SEQ ID NO:281)

Figure 63C

Pro664 a87H3 hF12 (S59Y) sdAb – aCD3 Vh (2B2) – NCL-8 – aCD3Vl (2B2) - a87H3 hF12 sdAb

– MMP9-15 - aCD3Vli – NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGNTYYADSVKG</u>RFTISRDNSKNTLYL
QMNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFN
KYAIN</u>WVRQAPGKGLEWVA<u>RIRSKYNNYATYYADQVK</u>DRFTISRDDSKNTAYLQMNNLKTEDTAVYYCVR<u>HANFGNSYISY
WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL
VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGNTYYADSVKG</u>RFTISRDNSKNTLYLQMNSLRAEDTAVYYCAA<u>GG
VLAHHNYEYDY</u>WGQGTLVTVSS/<u>SGGPGPAGMKGLPGS</u>/QTVVTQEPSLTVSPGGTVTLTC<u>GSSTGAVTSGNYPN</u>WVQQK
PGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKYAMN</u>WVRQAPGKGLEWVA<u>RIRSKYDYKDDDDKADSVKD</u>RFTISRDDSKNTA
YLQMNNLKTEDTAVYYCVR<u>HGNFGNSYISYWAY</u>WGQGTLVTVSS/<u>GGGGSGGGS</u>/EVQLVESGGGLVQPGNSLRLSCAAS<u>G
FTFSKFGMS</u>WVRQAPGKGLEWVS<u>SISGSGRDTLYAESVKG</u>RFTISRDNAKTTLYLQMNSLRPEDTAVYYCT<u>GGSLS</u>VSSQGT
LVTVSS/HHHHHH (SEQ ID NO:282)

Pro665 a87H3 hF12 (N57Q) sdAb – aCD3 Vh (2B2) – NCL-8 – aCD3Vl (2B2) - a87H3 hF12 sdAb

– MMP9-15 - aCD3Vli – NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGQTSYADSVKG</u>RFTISRDNSKNTLYL
QMNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFN
KYAIN</u>WVRQAPGKGLEWVA<u>RIRSKYNNYATYYADQVK</u>DRFTISRDDSKNTAYLQMNNLKTEDTAVYYCVR<u>HANFGNSYISY
WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL
VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGQTSYADSVKG</u>RFTISRDNSKNTLYLQMNSLRAEDTAVYYCAA<u>GG
VLAHHNYEYDY</u>WGQGTLVTVSS/<u>SGGPGPAGMKGLPGS</u>/QTVVTQEPSLTVSPGGTVTLTC<u>GSSTGAVTSGNYPN</u>WVQQK
PGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKYAMN</u>WVRQAPGKGLEWVA<u>RIRSKYDYKDDDDKADSVKD</u>RFTISRDDSKNTA
YLQMNNLKTEDTAVYYCVR<u>HGNFGNSYISYWAY</u>WGQGTLVTVSS/<u>GGGGSGGGS</u>/EVQLVESGGGLVQPGNSLRLSCAAS<u>G
FTFSKFGMS</u>WVRQAPGKGLEWVS<u>SISGSGRDTLYAESVKG</u>RFTISRDNAKTTLYLQMNSLRPEDTAVYYCT<u>GGSLS</u>VSSQGT
LVTVSS/HHHHHH (SEQ ID NO:283)

Figure 63D

Pro667 aB7H3 hF12 (N57E) sdAb – aCD3 Vh (2B2) – NCL-8 – aCD3Vl (2B2) - aB7H3 hF12 sdAb

– MMP9-15 - aCD3Vll – NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGETSYADSVK</u>GRFTISRDNSKNTLYLQ
MNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFNK</u>
<u>YAIN</u>WVRQAPGKGLEWVA<u>RIRSKYNNYATYYADQVKD</u>RFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGETSYADSVK</u>GRFTISRDNSKNTLYLQMNSLRAEDTAVYYCAA<u>GGV</u>
<u>LAHHNYEYDY</u>WGQGTLVTVSS/<u>SGGPGPAGMKGLPGS</u>/QTVVTQEPSLTVSPGGTVTLTC<u>GSSTGAVTSGNYPN</u>WVQQKP
GQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EVQ
LVESGGGLVQPGGSLKLSCAAS<u>GFTFNKYAMN</u>WVRQAPGKGLEWVA<u>RIRSKYDYKDDDDKADSVKD</u>RFTISRDDSKNTAYL
QMNNLKTEDTAVYYCVR<u>HGNFGNSYISYWAY</u>WGQGTLVTVSS/<u>GGGSGGGS</u>/EVQLVESGGGLVQPGNSLRLSCAAS<u>GFT</u>
<u>FSKFGMS</u>WVRQAPGKGLEWVS<u>SISGSGRDTLYAESVK</u>GRFTISRDNAKTTLYLQMNSLRPEDTAVYYCT<u>IGGSLS</u>VSSQGTLV
TVSS/HHHHHH (SEQ ID NO:284)

Pro694 aB7H3 hF12 (S59A) sdAb – aCD3 Vh (2B2) – NCL-8 – aCD3Vl (2B2) - aB7H3 hF12 sdAb

– MMP9-15 - aCD3Vll – NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGNTAYADSVK</u>GRFTISRDNSKNTLYL
QMNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFN</u>
<u>KYAIN</u>WVRQAPGKGLEWVA<u>RIRSKYNNYATYYADQVKD</u>RFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGNTAYADSVK</u>GRFTISRDNSKNTLYLQMNSLRAEDTAVYYCAA<u>GG</u>
<u>VLAHHNYEYDY</u>WGQGTLVTVSS/<u>SGGPGPAGMKGLPGS</u>/QTVVTQEPSLTVSPGGTVTLTC<u>GSSTGAVTSGNYPN</u>WVQQK
PGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKYAMN</u>WVRQAPGKGLEWVA<u>RIRSKYDYKDDDDKADSVKD</u>RFTISRDDSKNTA
YLQMNNLKTEDTAVYYCVR<u>HGNFGNSYISYWAY</u>WGQGTLVTVSS/<u>GGGSGGGS</u>/EVQLVESGGGLVQPGNSLRLSCAAS<u>G</u>
<u>FTFSKFGMS</u>WVRQAPGKGLEWVS<u>SISGSGRDTLYAESVK</u>GRFTISRDNAKTTLYLQMNSLRPEDTAVYYCT<u>IGGSLS</u>VSSQGT
LVTVSS/HHHHHH (SEQ ID NO:285)

Figure 63E

Pro695 aB7H3 hF12 (N57D) sdAb – aCD3 Vh (2B2) – NCL-8 – aCD3Vl (2B2) - aB7H3 hF12 sdAb

– MMP9-15 - aCD3Vll – NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGDTSYADSVK</u>GRFTISRDNSKNTLYLQ
MNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFNK</u>
<u>YAIN</u>WVRQAPGKGLEWVA<u>RIRSKYNNYATYYADQVK</u>DRFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGDTSYADSVK</u>GRFTISRDNSKNTLYLQMNSLRAEDTAVYYCAA<u>GG</u>
<u>VLAHHNYEYDY</u>WGQGTLVTVSS/<u>SGGPGPAGMKGLPGS</u>/QTVVTQEPSLTVSPGGTVTLTC<u>GSSTGAVTSGNYPN</u>WVQQK
PGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKYAMN</u>WVRQAPGKGLEWVA<u>RIRSKYDYKDDDDKADSVK</u>DRFTISRDDSKNTA
YLQMNNLKTEDTAVYYCVR<u>HGNFGNSYISYWAY</u>WGQGTLVTVSS/<u>GGGGSGGGS</u>/EVQLVESGGGLVQPGNSLRLSCAAS<u>G</u>
<u>FTFSKFGMS</u>WVRQAPGKGLEWVS<u>SISGSGRDTLYAESVK</u>GRFTISRDNAKTTLYLQMNSLRPEDTAVYYCT<u>GGSLS</u>VSSQGT
LVTVSS/HHHHHH (SEQ ID NO:286)

Pro766 aB7H3 hF12 sdAb – aCD3 Vh (2B2) – NCL-8 – aCD3Vl (2B2) - aB7H3 hF12 sdAb

– NCL-15 - aCD3Vll –NCL-8 - aCD3Vhi – aHSA (10GE) - His6

QVQLQESGGGLVQPGGSLRLSCEAS<u>PRTFSTYSMA</u>WFRQAPGKERSFVA<u>AINWSGGNTYYADSVK</u>GRFTISRDNSKNTLYL
QMNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFN</u>
<u>KYAIN</u>WVRQAPGKGLEWVA<u>RIRSKYNNYATYYADQVK</u>DRFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGNTYYADSVK</u>GRFTISRDNSKNTLYLQMNSLRAEDTAVYYCAA<u>GG</u>
<u>VLAHHNYEYDY</u>WGQGTLVTVSS/<u>GGGSGGGSGGGS</u>/QTVVTQEPSLTVSPGGTVTLTC<u>GSSTGAVTSGNYPN</u>WVQQ
KPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKYAMN</u>WVRQAPGKGLEWVA<u>RIRSKYDYKDDDDKADSVK</u>DRFTISRDDSKNTA
YLQMNNLKTEDTAVYYCVR<u>HGNFGNSYISYWAY</u>WGQGTLVTVSS/<u>GGGGSGGGS</u>/EVQLVESGGGLVQPGNSLRLSCAAS<u>G</u>
<u>FTFSKFGMS</u>WVRQAPGKGLEWVS<u>SISGSGRDTLYAESVK</u>GRFTISRDNAKTTLYLQMNSLRPEDTAVYYCT<u>GGSLS</u>VSSQGT
LVTVSS/HHHHHH (SEQ ID NO:287)

Figure 63F

Pro565 acEpCAM hVIB664 sdAb – aCD3 Vh (2B2) – NCL-8 – aCD3Vl (2B2) – acEpCAM hVIB664 sdAb

– MMP9-15 - aCD3Vll – NCL-8 - aCD3Vhl – aHSA (10GE) - His6

QVQLLESGGGLVQPGGSLRLSCAAS<u>GRTLDNYDMG</u>WFRQGPGKEREFVA<u>AISWSGGSTDYAYSVKG</u>RFTISRDNSKNTLYL
QMNSLRAEDTAVYYCAA<u>DLRFTGGDTMTPETYDY</u>WGQGTLVTVSS/<u>GGGSGGGS</u>/EVQLVESGGGLVQPGGSLKLSCAAS<u>G
FTFNKYAIN</u>WVRQAPGKGLEWVA<u>RIRSKYNNYATYYADQVKD</u>RFTISRDDSKNTAYLQMNNLKTEDTAVYYCVR<u>HANFGN
SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G
TKFLVPG</u>TPARFSGSLLGGKAALTLSGVQPEDEAEYYC<u>TLWYSNRWV</u>FGGGTKLTVL/<u>GGGSGGGS</u>/QVQLLESGGGLVQPG
GSLRLSCAAS<u>GRTLDNYDMG</u>WFRQGPGKEREFVA<u>AISWSGGSTDYAYSVKG</u>RFTISRDNSKNTLYLQMNSLRAEDTAVYYC
AA<u>DLRFTGGDTMTPETYDY</u>WGQGTLVTVSS/*SGGPGPAGMKGLPGS*/QTVVTQEPSLTVSPGGTVTLTC<u>GSSTGAVTSGNY
PN</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGG
SGGGS</u>/EVQLVESGGGLVQPGGSLKLSCAAS<u>GFTFNKYAMN</u>WVRQAPGKGLEWVA<u>RIRSKYDYKDDDDKADSVKD</u>RFTISR
DDSKNTAYLQMNNLKTEDTAVYYCVR<u>HGNFGNSYISYWAY</u>WGQGTLVTVSS/<u>GGGGSGGGS</u>/EVQLVESGGGLVQPGNSL
RLSCAAS<u>GFTFSKFGMS</u>WVRQAPGKGLEWVS<u>SISGSGRDTLYAESVKG</u>RFTISRDNAKTTLYLQMNSLRPEDTAVYYCT<u>GGS
LS</u>VSSQGTLVTVSS/HHHHHH (SEQ ID NO:288)

Pro566 acEpCAM hVIB665 sdAb – aCD3 Vh (2B2) – NCL-8 – aCD3Vl (2B2) – acEpCAM hVIB665 sdAb

– MMP9-15 - aCD3Vll – NCL-8 - aCD3Vhl – aHSA (10GE) - His6

QVQLLESGGGLVQPGGSLRLSCAAS<u>GRTFSDYDMG</u>WFRQGPGKEREFVA<u>AISWSGGHTNYADSVKG</u>RFTISRDNSKNTLYL
QMNSLRAEDTAVYYCAA<u>DLRFTGGDTTTPETYDY</u>WGQGTLVTVSS/<u>GGGSGGGS</u>/EVQLVESGGGLVQPGGSLKLSCAAS<u>GF
TFNKYAIN</u>WVRQAPGKGLEWVA<u>RIRSKYNNYATYYADQVKD</u>RFTISRDDSKNTAYLQMNNLKTEDTAVYYCVR<u>HANFGNS
YISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GT
KFLVPG</u>TPARFSGSLLGGKAALTLSGVQPEDEAEYYC<u>TLWYSNRWV</u>FGGGTKLTVL/<u>GGGSGGGS</u>/QVQLLESGGGLVQPGG
SLRLSCAAS<u>GRTFSDYDMG</u>WFRQGPGKEREFVA<u>AISWSGGHTNYADSVKG</u>RFTISRDNSKNTLYLQMNSLRAEDTAVYYCA
A<u>DLRFTGGDTTTPETYDY</u>WGQGTLVTVSS/*SGGPGPAGMKGLPGS*/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSG
GGS</u>/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/<u>GGGGSGGGS</u>/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>
VSSQGTLVTVSS/HHHHHH (SEQ ID NO:289)

Figure 63G

Pro567 acEpCAM hVIB666 sdAb – aCD3 Vh (2B2) – NCL-8 – aCD3Vl (2B2) – acEpCAM hVIB666 sdAb

– MMP9-15 - aCD3VlI – NCL-8 - aCD3VhI – aHSA (10GE) - His6

QVQLVESGGGLVQPGRSLRLSCAAS<u>GRTLDNYDMG</u>WFRQGPGKEREFVA<u>AISWSGGSTDYAYSVT</u>GRFTISRDNAKNSLYL
QMNSLRAEDTALYYCAA<u>DLRFTGGDTMTPETYDY</u>WGQGTLVTVSS/<u>GGGSGGGS</u>/EVQLVESGGGLVQPGGSLKLSCAAS<u>G</u>
<u>FTFNKYAIN</u>WVRQAPGKGLEWVA<u>RIRSKYNNYATYYADQVKD</u>RFTISRDDSKNTAYLQMNNLKTEDTAVYYCVR<u>HANFGN</u>
<u>SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G</u>
<u>TKFLVP</u>GTPARFSGSLLGGKAALTLSGVQPEDEAEYYC<u>TLWYSNRWV</u>FGGGTKLTVL/<u>GGGSGGGS</u>/QVQLVESGGGLVQPG
RSLRLSCAAS<u>GRTLDNYDMG</u>WFRQGPGKEREFVA<u>AISWSGGSTDYAYSVT</u>GRFTISRDNAKNSLYLQMNSLRAEDTALYYCA
A<u>DLRFTGGDTMTPETYDY</u>WGQGTLVTVSS/<u>SGGPGPAGMKGLPGS</u>/QTVVTQEPSLTVSPGGTVTLTC<u>GSSTGAVTSGNYP</u>
<u>N</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGS</u>
<u>GGGS</u>/EVQLVESGGGLVQPGGSLKLSCAAS<u>GFTFNKYAMN</u>WVRQAPGKGLEWVA<u>RIRSKYDYKDDDDKADSVKD</u>RFTISR
DDSKNTAYLQMNNLKTEDTAVYYCVR<u>HGNFGNSYISYWAY</u>WGQGTLVTVSS/<u>GGGGSGGGS</u>/EVQLVESGGGLVQPGNSL
RLSCAAS<u>GFTFSKFGMS</u>WVRQAPGKGLEWVS<u>SISGSGRDTLYAESVKG</u>RFTISRDNAKTTLYLQMNSLRPEDTAVYYCT<u>IGGS</u>
<u>LS</u>VSSQGTLVTVSS/HHHHHH (SEQ ID NO:290)

Pro568 acEpCAM hVIB664 sdAb – aCD3 Vh (2B2) – NCL-8 – aCD3Vl (2B2) – acEpCAM hVIB664 sdAb

– NCL-16 - aCD3VlI – NCL-8 - aCD3VhI – aHSA (10GE) - His6

QVQLLESGGGLVQPGGSLRLSCAAS<u>GRTLDNYDMG</u>WFRQGPGKEREFVA<u>AISWSGGSTDYAYSVK</u>GRFTISRDNSKNTLYL
QMNSLRAEDTAVYYCAA<u>DLRFTGGDTMTPETYDY</u>WGQGTLVTVSS/<u>GGGSGGGS</u>/EVQLVESGGGLVQPGGSLKLSCAAS<u>G</u>
<u>FTFNKYAIN</u>WVRQAPGKGLEWVA<u>RIRSKYNNYATYYADQVKD</u>RFTISRDDSKNTAYLQMNNLKTEDTAVYYCVR<u>HANFGN</u>
<u>SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G</u>
<u>TKFLVP</u>GTPARFSGSLLGGKAALTLSGVQPEDEAEYYC<u>TLWYSNRWV</u>FGGGTKLTVL/<u>GGGSGGGS</u>/QVQLLESGGGLVQPG
GSLRLSCAAS<u>GRTLDNYDMG</u>WFRQGPGKEREFVA<u>AISWSGGSTDYAYSVK</u>GRFTISRDNSKNTLYLQMNSLRAEDTAVYYC
AA<u>DLRFTGGDTMTPETYDY</u>WGQGTLVTVSS/<u>GGGSGGGSGGGS</u>/QTVVTQEPSLTVSPGGTVTLTC<u>GSSTGAVTSGNY</u>
<u>PN</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGG</u>
<u>SGGGS</u>/EVQLVESGGGLVQPGGSLKLSCAAS<u>GFTFNKYAMN</u>WVRQAPGKGLEWVA<u>RIRSKYDYKDDDDKADSVKD</u>RFTISR
DDSKNTAYLQMNNLKTEDTAVYYCVR<u>HGNFGNSYISYWAY</u>WGQGTLVTVSS/<u>GGGSGGGS</u>/EVQLVESGGGLVQPGNSL
RLSCAAS<u>GFTFSKFGMS</u>WVRQAPGKGLEWVS<u>SISGSGRDTLYAESVKG</u>RFTISRDNAKTTLYLQMNSLRPEDTAVYYCT<u>IGGS</u>
<u>LS</u>VSSQGTLVTVSS/HHHHHH (SEQ ID NO:291)

Figure 63H

Pro727 acEpCAM hVIB664 sdAb – aCD3 Vh (2B2) – NCL-8 – aCD3Vl (2B2) – acEpCAM hVIB664 sdAb

– Meprin-15 - aCD3Vli - NCL-8 - aCD3Vhi – aHSA (10GE) - His6

QVQLLESGGGLVQPGGSLRLSCAASGRTLDNYDMGWFRQGPGKEREFVAAISWSGGSTDYAYSVKGRFTISRDNSKNTLYL QMNSLRAEDTAVYYCAADLRFTGGDTMTPETYDYWGQGTLVTVSS/GGGSGGGS/EVQLVESGGGLVQPGGSLKLSCAASG FTFNKYAINWVRQAPGKGLEWVARIRSKYNNYATYYADQVKDRFTISRDDSKNTAYLQMNNLKTEDTAVYYCVRHANFGN SYISYWAYWGQGTLVTVSS/GGGSGGGS/QTVVTQEPSLTVSPGGTVTLTCASSTGAVTSGNYPNWVQQKPGQAPRGLIGG TKFLVPGTPARFSGSLLGGKAALTLSGVQPEDEAEYYCTLWYSNRWVFGGGTKLTVL/GGGSGGGS/QVQLLESGGGLVQPG GSLRLSCAASGRTLDNYDMGWFRQGPGKEREFVAAISWSGGSTDYAYSVKGRFTISRDNSKNTLYLQMNSLRAEDTAVYYC AADLRFTGGDTMTPETYDYWGQGTLVTVSS/SGGGKKLADEPEGGS/QTVVTQEPSLTVSPGGTVTLTCGSSTGAVTSGNYP NWVQQKPGQAPRGLIGDYKDDDDKGTPARFSGSLLGGKAALTLSGVQPEDEAEYYCVLWYSNRWVFGGGTKLTVL/GGGS GGGS/EVQLVESGGGLVQPGGSLKLSCAASGFTFNKYAMNWVRQAPGKGLEWVARIRSKYDYKDDDDKADSVKDRFTISR DDSKNTAYLQMNNLKTEDTAVYYCVRHGNFGNSYISYWAYWGQGTLVTVSS/GGGSGGGS/EVQLVESGGGLVQPGNSL RLSCAASGFTFSKFGMSWVRQAPGKGLEWVSSISGSGRDTLYAESVKGRFTISRDNAKTTLYLQMNSLRPEDTAVYYCTIGGS LSVSSQGTLVTVSS/HHHHHH (SEQ ID NO:292)

Pro728 acEpCAM hVIB664 sdAb – aCD3 Vh (2B2) – NCL-8 – aCD3Vl (2B2) – acEpCAM hVIB664 sdAb

– MMP9v - aCD3Vli - NCL-8 - aCD3Vhi – aHSA (10GE) - His6

QVQLLESGGGLVQPGGSLRLSCAASGRTLDNYDMGWFRQGPGKEREFVAAISWSGGSTDYAYSVKGRFTISRDNSKNTLYL QMNSLRAEDTAVYYCAADLRFTGGDTMTPETYDYWGQGTLVTVSS/GGGSGGGS/EVQLVESGGGLVQPGGSLKLSCAASG FTFNKYAINWVRQAPGKGLEWVARIRSKYNNYATYYADQVKDRFTISRDDSKNTAYLQMNNLKTEDTAVYYCVRHANFGN SYISYWAYWGQGTLVTVSS/GGGSGGGS/QTVVTQEPSLTVSPGGTVTLTCASSTGAVTSGNYPNWVQQKPGQAPRGLIGG TKFLVPGTPARFSGSLLGGKAALTLSGVQPEDEAEYYCTLWYSNRWVFGGGTKLTVL/GGGSGGGS/QVQLLESGGGLVQPG GSLRLSCAASGRTLDNYDMGWFRQGPGKEREFVAAISWSGGSTDYAYSVKGRFTISRDNSKNTLYLQMNSLRAEDTAVYYC AADLRFTGGDTMTPETYDYWGQGTLVTVSS/GSGGPGPAGMHGLPGGS/QTVVTQEPSLTVSPGGTVTLTCGSSTGAVTSG NYPNWVQQKPGQAPRGLIGDYKDDDDKGTPARFSGSLLGGKAALTLSGVQPEDEAEYYCVLWYSNRWVFGGGTKLTVL/G GGSGGGS/EVQLVESGGGLVQPGGSLKLSCAASGFTFNKYAMNWVRQAPGKGLEWVARIRSKYDYKDDDDKADSVKDRFT ISRDDSKNTAYLQMNNLKTEDTAVYYCVRHGNFGNSYISYWAYWGQGTLVTVSS/GGGSGGGS/EVQLVESGGGLVQPG NSLRLSCAASGFTFSKFGMSWVRQAPGKGLEWVSSISGSGRDTLYAESVKGRFTISRDNAKTTLYLQMNSLRPEDTAVYYCTI GGSLSVSSQGTLVTVSS/HHHHHH (SEQ ID NO:293)

Figure 63I

Pro729 acEpCAM hVIB664 sdAb – aCD3 Vh (2B2) – NCL-8 – aCD3VI (2B2) – acEpCAM hVIB664 sdAb

– CathS - aCD3Vli – NCL-8 - aCD3Vhi – aHSA (10GE) - His6

QVQLLESGGGLVQPGGSLRLSCAAS<u>GRTLDNYDMG</u>WFRQGPGKEREFVA<u>AISWSGGSTDYAYSVKG</u>RFTISRDNSKNTLYL
QMNSLRAEDTAVYYCAA<u>DLRFTGGDTMTPETYDY</u>WGQGTLVTVSS/<u>GGGSGGGS</u>/EVQLVESGGGLVQPGGSLKLSCAAS<u>G
FTFNKYAIN</u>WVRQAPGKGLEWVA<u>RIRSKYNNYATYYADQVKD</u>RFTISRDDSKNTAYLQMNNLKTEDTAVYYCVR<u>HANFGN
SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G
TKFLVP</u>GTPARFSGSLLGGKAALTLSGVQPEDEAEYYC<u>TLWYSNRWV</u>FGGGTKLTVL/<u>GGGSGGGS</u>/QVQLLESGGGLVQPG
GSLRLSCAAS<u>GRTLDNYDMG</u>WFRQGPGKEREFVA<u>AISWSGGSTDYAYSVKG</u>RFTISRDNSKNTLYLQMNSLRAEDTAVYYC
AA<u>DLRFTGGDTMTPETYDY</u>WGQGTLVTVSS/*<u>GGGSARLQSAAPGGGS</u>*/QTVVTQEPSLTVSPGGTVTLTC<u>SSTGAVTSGN
YPN</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>GG
GSGGGS</u>/EVQLVESGGGLVQPGGSLKLSCAAS<u>GFTFNKYAMN</u>WVRQAPGKGLEWVA<u>RIRSKYDYKDDDDKADSVKD</u>RFTI
SRDDSKNTAYLQMNNLKTEDTAVYYCVR<u>HGNFGNSYISYWAY</u>WGQGTLVTVSS/<u>GGGGSGGGS</u>/EVQLVESGGGLVQPGN
SLRLSCAAS<u>GFTFSKFGMS</u>WVRQAPGKGLEWVS<u>SISGSGRDTLYAESVKG</u>RFTISRDNAKTTLYLQMNSLRPEDTAVYYCTI<u>G
GSLS</u>VSSQGTLVTVSS/HHHHHH (SEQ ID NO:294)

Pro730 acEpCAM hVIB664 sdAb – aCD3 Vh (2B2) – NCL-8 – aCD3VI (2B2) – acEpCAM hVIB664 sdAb

– S9 - aCD3Vli – NCL-8 - aCD3Vhi – aHSA (10GE) - His6

QVQLLESGGGLVQPGGSLRLSCAAS<u>GRTLDNYDMG</u>WFRQGPGKEREFVA<u>AISWSGGSTDYAYSVKG</u>RFTISRDNSKNTLYL
QMNSLRAEDTAVYYCAA<u>DLRFTGGDTMTPETYDY</u>WGQGTLVTVSS/<u>GGGSGGGS</u>/EVQLVESGGGLVQPGGSLKLSCAAS<u>G
FTFNKYAIN</u>WVRQAPGKGLEWVA<u>RIRSKYNNYATYYADQVKD</u>RFTISRDDSKNTAYLQMNNLKTEDTAVYYCVR<u>HANFGN
SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G
TKFLVP</u>GTPARFSGSLLGGKAALTLSGVQPEDEAEYYC<u>TLWYSNRWV</u>FGGGTKLTVL/<u>GGGSGGGS</u>/QVQLLESGGGLVQPG
GSLRLSCAAS<u>GRTLDNYDMG</u>WFRQGPGKEREFVA<u>AISWSGGSTDYAYSVKG</u>RFTISRDNSKNTLYLQMNSLRAEDTAVYYC
AA<u>DLRFTGGDTMTPETYDY</u>WGQGTLVTVSS/*<u>GARLQSAAPAGLKGAG</u>*/QTVVTQEPSLTVSPGGTVTLTC<u>GSSTGAVTSGNY
PN</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGG
SGGGS</u>/EVQLVESGGGLVQPGGSLKLSCAAS<u>GFTFNKYAMN</u>WVRQAPGKGLEWVA<u>RIRSKYDYKDDDDKADSVKD</u>RFTISR
DDSKNTAYLQMNNLKTEDTAVYYCVR<u>HGNFGNSYISYWAY</u>WGQGTLVTVSS/<u>GGGGSGGGS</u>/EVQLVESGGGLVQPGNSL
RLSCAAS<u>GFTFSKFGMS</u>WVRQAPGKGLEWVS<u>SISGSGRDTLYAESVKG</u>RFTISRDNAKTTLYLQMNSLRPEDTAVYYCTI<u>GGS
LS</u>VSSQGTLVTVSS/HHHHHH (SEQ ID NO:295)

Figure 63J

Pro731 acEpCAM hVIB664 sdAb – aCD3 Vh (2B2) – NCL-8 – aCD3Vl (2B2) – acEpCAM hVIB664 sdAb
– ST14-MS - aCD3Vli – NCL-8 – aCD3Vhi – aHSA (10GE) - His6

QVQLLESGGGLVQPGGSLRLSCAASGRTLDNYDMGWFRQGPGKEREFVAAISWSGGSTDYAYSVKGRFTISRDNSKNTLYL
QMNSLRAEDTAVYYCAADLRFTGGDTMTPETYDYWGQGTLVTVSS/*GGGSGGGS*/EVQLVESGGGLVQPGGSLKLSCAAS**G
FTFNKYAINWVRQAPGKGLEWVARIRSKYNNYATYYADQVKDRFTISRDDSKNTAYLQMNNLKTEDTAVYYCVRHANFG**N
SYISYWAYWGQGTLVTVSS/*GGGSGGGS*/QTVVTQEPSLTVSPGGTVTLTCASSTGAVTSGNYPNWVQQKPGQAPRGLIG**G
TKFLVPGTPARFSGSLLGGKAALTLSGVQPEDEAEYYCTLWYSNRWV**FGGGTKLTVL/*GGGSGGGS*/QVQLLESGGGLVQPG
GSLRLSCAASGRTLDNYDMGWFRQGPGKEREFVAAISWSGGSTDYAYSVKGRFTISRDNSKNTLYLQMNSLRAEDTAVYYC
AADLRFTGGDTMTPETYDYWGQGTLVTVSS/*GGGSLSGRSDNH GGGS*/QTVVTQEPSLTVSPGGTVTLTC**GSSTGAVTSGN
YPNWVQQKPGQAPRGLIGDYKDDDDKGTPARFSGSLLGGKAALTLSGVQPEDEAEYYCVLWYSNRWVFGGGTKLTVL/GG
GSGGGS/EVQLVESGGGLVQPGGSLKLSCAASGFTFNKYAMNWVRQAPGKGLEWVARIRSKYDYKDDDDKADSVKD**RFTI
SRDDSKNTAYLQMNNLKTEDTAVYYCVRHGNFGNSYISYWAYWGQGTLVTVSS/*GGGSGGGS*/EVQLVESGGGLVQPGN
SLRLSCAASGFTFSKFGMSWVRQAPGKGLEWVSSISGSGRDTLYAESVKGRFTISRDNAKTTLYLQMNSLRPEDTAVYYCTI**G
GSLS**VSSQGTLVTVSS/HHHHHH (SEQ ID NO:296)

Pro676 aTrop2 hVIB565 sdAb – aCD3 Vh (2B2) – NCL-8 – aCD3Vl (2B2) – aTrop2 hVIB565 sdAb
– MMP9-15 - aCD3Vli – NCL-8 – aCD3Vhi – aHSA (10GE) - His6

QVQLLESGGGLVQPGGSLRLSCAASGFTFDYYAIGWFRQAPGKEREGVSCISSSHGSTYYADSVKGRFTISRDNSKNTVYLQM
NSLRAEDTAVYYCATAGDGGDYHCGLVDYGMDYWGKGTLVTVSS/*GGGSGGGS*/EVQLVESGGGLVQPGGSLKLSCAAS
GFTFNKYAINWVRQAPGKGLEWVARIRSKYNNYATYYADQVKDRFTISRDDSKNTAYLQMNNLKTEDTAVYYCVR**HANFG
NSYISYWAY**WGQGTLVTVSS/*GGGSGGGS*/QTVVTQEPSLTVSPGGTVTLTCASSTGAVTSGNYPNWVQQKPGQAPRGLIG
GTKFLVPGTPARFSGSLLGGKAALTLSGVQPEDEAEYYCTLWYSNRWVFGGGTKLTVL/*GGGSGGGS*/QVQLLESGGGLVQP
GGSLRLSCAASGFTFDYYAIGWFRQAPGKEREGVSCISSSHGSTYYADSVKGRFTISRDNSKNTVYLQMNSLRAEDTAVYYCAT
AGDGGDYHCGLVDYGMDYWGKGTLVTVSS/*SGGPGPAGMKGLPGS*/QTVVTQEPSLTVSPGGTVTLTC**GSSTGAVTSGN
YPNWVQQKPGQAPRGLIGDYKDDDDKGTPARFSGSLLGGKAALTLSGVQPEDEAEYYCVLWYSNRWVFGGGTKLTVL/GG
GSGGGS/EVQLVESGGGLVQPGGSLKLSCAASGFTFNKYAMNWVRQAPGKGLEWVARIRSKYDYKDDDDKADSVKD**RFTI
SRDDSKNTAYLQMNNLKTEDTAVYYCVRHGNFGNSYISYWAYWGQGTLVTVSS/*GGGSGGGS*/EVQLVESGGGLVQPGN
SLRLSCAASGFTFSKFGMSWVRQAPGKGLEWVSSISGSGRDTLYAESVKGRFTISRDNAKTTLYLQMNSLRPEDTAVYYCTI**G
GSLS**VSSQGTLVTVSS/HHHHHH (SEQ ID NO:297)

Figure 63K

Pro677 aTrop2 hVIB557 sdAb sdAb – aCD3 Vh (2B2) – NCL-8 – aCD3Vl (2B2) – aTrop2 hVIB557 sdAb sdAb – MMP9-15 - aCD3Vll – NCL-8 – aCD3Vhl – aHSA (10GE) - His6

QVQLLESGGGLVQPGGSLRLSCAAS<u>GRTFSSQSMG</u>WFRQAPGKEREFVS<u>AISWTGANPTYADSVKG</u>RFTISRDNSKNTLYLQ MNSLRAEDTAVYYCAA<u>DTSGGSYYYERATAETSYDY</u>WGQGTLVTVSS/<u>GGGSGGGS</u>/EVQLVESGGGLVQPGGSLKLSCAAS <u>GFTFNKYAIN</u>WVRQAPGKGLEWVA<u>RIRSKYNNYATYYADQVKD</u>RFTISRDDSKNTAYLQMNNLKTEDTAVYYCVR<u>HANFG NSYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG <u>GTKFL</u>VPGTPARFSGSLLGGKAALTLSGVQPEDEAEYYC<u>TLWYSNRWV</u>FGGGTKLTVL/<u>GGGSGGGS</u>/QVQLLESGGGLVQP GGSLRLSCAAS<u>GRTFSSQSMG</u>WFRQAPGKEREFVS<u>AISWTGANPTYADSVKG</u>RFTISRDNSKNTLYLQMNSLRAEDTAVYYC AA<u>DTSGGSYYYERATAETSYDY</u>WGQGTLVTVSS/*SGGPGPAGMKGLPGS*/QTVVTQEPSLTVSPGGTVTLTC<u>GSSTGAVTSG NYPN</u>WVQQKPGQAPRGLIG<u>DYKDDDDK</u>GTPARFSGSLLGGKAALTLSGVQPEDEAEYYC<u>VLWYSNRWV</u>FGGGTKLTVL/<u>G GGSGGGS</u>/EVQLVESGGGLVQPGGSLKLSCAAS<u>GFTFNKYAMN</u>WVRQAPGKGLEWVA<u>RIRSKYDYKDDDDKADSVKD</u>RFT ISRDDSKNTAYLQMNNLKTEDTAVYYCVR<u>HGNFGNSYISYWAY</u>WGQGTLVTVSS/<u>GGGGSGGGS</u>/EVQLVESGGGLVQPG NSLRLSCAAS<u>GFTFSKFGMS</u>WVRQAPGKGLEWVS<u>SISGSGRDTLYAESVKG</u>RFTISRDNAKTTLYLQMNSLRPEDTAVYYCTI <u>GGSLS</u>VSSQGTLVTVSS/HHHHHH (SEQ ID NO:298)

Pro678 aTrop2 hVIB575 sdAb – aCD3 Vh (2B2) – NCL-8 – aCD3Vl (2B2) – aTrop2 hVIB575 sdAb – MMP9-15 - aCD3Vll – NCL-8 – aCD3Vhl – aHSA (10GE) - His6

QVQLLESGGGLVQPGGSLRLSCLAS<u>GRTVGRTAMG</u>WFRQPPGKEREFVA<u>TISWAGGTTYYADFVKG</u>RFTISRDNSKNTLYLQ MNSLRAEDTAVYYCAA<u>SEPYSDYDPSGMVY</u>WGKGTLVTVSS/<u>GGGSGGGS</u>/EVQLVESGGGLVQPGGSLKLSCAAS<u>GFTFN KYAIN</u>WVRQAPGKGLEWVA<u>RIRSKYNNYATYYADQVKD</u>RFTISRDDSKNTAYLQMNNLKTEDTAVYYCVR<u>HANFGNSYISY WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL VP</u>GTPARFSGSLLGGKAALTLSGVQPEDEAEYYC<u>TLWYSNRWV</u>FGGGTKLTVL/<u>GGGSGGGS</u>/QVQLLESGGGLVQPGGSLR LSCLAS<u>GRTVGRTAMG</u>WFRQPPGKEREFVA<u>TISWAGGTTYYADFVKG</u>RFTISRDNSKNTLYLQMNSLRAEDTAVYYCAA<u>SEP YSDYDPSGMVY</u>WGKGTLVTVSS/*SGGPGPAGMKGLPGS*/QTVVTQEPSLTVSPGGTVTLTC<u>GSSTGAVTSGNYPN</u>WVQQK PGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV QLVESGGGLVQPGGSLKLSCAAS<u>GFTFNKYAMN</u>WVRQAPGKGLEWVA<u>RIRSKYDYKDDDDKADSVKD</u>RFTISRDDSKNTA YLQMNNLKTEDTAVYYCVR<u>HGNFGNSYISYWAY</u>WGQGTLVTVSS/<u>GGGSGGGS</u>/EVQLVESGGGLVQPGNSLRLSCAAS<u>G FTFSKFGMS</u>WVRQAPGKGLEWVS<u>SISGSGRDTLYAESVKG</u>RFTISRDNAKTTLYLQMNSLRPEDTAVYYCTI<u>GGSLS</u>VSSQGT LVTVSS/HHHHHH (SEQ ID NO:299)

Figure 63L

Pro679 aTrop2 hVIB578 sdAb – aCD3 Vh (2B2) – NCL-8 – aCD3Vl (2B2) – aTrop2 hVIB578 sdAb – MMP9-15 – aCD3Vlí – NCL-8 – aCD3Vhi – aHSA (10GE) – His6

QVQLLESGGGLVQPGGSLRLSCAAS<u>GRTFGRAAMG</u>WFRQPPGKEREFAAT<u>ISWSGSNTYYADFVKG</u>RFTISRDNSKNTVYL
QMNSLRAEDTAVYYCAA<u>SEPYSDYDPSGMVY</u>WGKGTLVTVSS/*GGGSGGGS*/EVQLVESGGGLVQPGGSLKLSCAAS<u>GFTF
NKYAIN</u>WVRQAPGKGLEWVA<u>RIRSKYNNYATYYADQVKD</u>RFTISRDDSKNTAYLQMNNLKTEDTAVYYCVR<u>HANFGNSYIS
YWAY</u>WGQGTLVTVSS/*GGGSGGGS*/QTVVTQEPSLTVSPGGTVTLTC<u>ASSTGAVTSGNYPN</u>WVQQKPGQAPRGLIG<u>GTKF
LVPG</u>TPARFSGSLLGGKAALTLSGVQPEDEAEYYC<u>TLWYSNRWV</u>FGGGTKLTVL/*GGGSGGGS*/QVQLLESGGGLVQPGGSL
RLSCAAS<u>GRTFGRAAMG</u>WFRQPPGKEREFAAT<u>ISWSGSNTYYADFVKG</u>RFTISRDNSKNTVYLQMNSLRAEDTAVYYCAA<u>S
EPYSDYDPSGMVY</u>WGKGTLVTVSS/*SGGPGPAGMKGLPGS*/QTVVTQEPSLTVSPGGTVTLTC<u>GSSTGAVTSGNYPN</u>WVQ
QKPGQAPRGLIG<u>DYKDDDDK</u>GTPARFSGSLLGGKAALTLSGVQPEDEAEYYC<u>VLWYSNRWV</u>FGGGTKLTVL/*GGGSGGGS*/
EVQLVESGGGLVQPGGSLKLSCAAS<u>GFTFNKYAMN</u>WVRQAPGKGLEWVA<u>RIRSKYDYKDDDDKADSVKD</u>RFTISRDDSKN
TAYLQMNNLKTEDTAVYYCVR<u>HGNFGNSYISYWAY</u>WGQGTLVTVSS/*GGGSGGGS*/EVQLVESGGGLVQPGNSLRLSCAA
S<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>VSSQ
GTLVTVSS/HHHHHH (SEQ ID NO:300)

Pro808 aTROP2 hVIB609 sdAb – aCD3 Vh (2B2) – NCL-8 – aCD3Vl (2B2) – aTROP2 hVIB609 sdAb

– MMP9-15 – aCD3Vli –NCL-8 – aCD3Vhi – aHSA (10GE) – His6

QVQLLESGGGLVQPGGSLRLSCALS<u>GLTFNTYPMA</u>WFRQPPGQEREFVA<u>DMSWSGTNTYYADSVKG</u>RFTISRDNSKNTLYL
QMNSLRAEDTAVYYCAA<u>GWPYSGTGRSTTDYTY</u>WGQGTLVTVSS/*GGGSGGGS*/EVQLVESGGGLVQPGGSLKLSCAAS<u>GF
TFNKYAIN</u>WVRQAPGKGLEWVA<u>RIRSKYNNYATYYADQVKD</u>RFTISRDDSKNTAYLQMNNLKTEDTAVYYCVR<u>HANFGNS
YISYWAY</u>WGQGTLVTVSS/*GGGSGGGS*/QTVVTQEPSLTVSPGGTVTLTC<u>ASSTGAVTSGNYPN</u>WVQQKPGQAPRGLIG<u>GT
KFLVPG</u>TPARFSGSLLGGKAALTLSGVQPEDEAEYYC<u>TLWYSNRWV</u>FGGGTKLTVL/*GGGSGGGS*/QVQLLESGGGLVQPGG
SLRLSCALS<u>GLTFNTYPMA</u>WFRQPPGQEREFVA<u>DMSWSGTNTYYADSVKG</u>RFTISRDNSKNTLYLQMNSLRAEDTAVYYCA
A<u>GWPYSGTGRSTTDYTY</u>WGQGTLVTVSS/*SGGPGPAGMKGLPGS*/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/*GGGSG
GGS*/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/*GGGSGGGS*/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>
VSSQGTLVTVSS/HHHHHH (SEQ ID NO:301)

Figure 63M

Pro819 aTROP2 hVIB619 sdAb – aCD3 Vh (2B2) – NCL-8 – aCD3Vl (2B2) – aTROP2 hVIB619 sdAb

– MMP9-15 - aCD3Vli –NCL-8 - aCD3Vhi – aHSA (10GE) - His6

QVQLLESGGGLVQPGGSLRLSCAAS<u>GRSFSRYGMG</u>WLRQAPGKERELVAS<u>ISWSGHSTYYADSVKG</u>RFTISRDNSKNTLYLQ
MNSLRAEDTAVYYCAA<u>ESLPYESGSPRLTDFAS</u>WGQGTLVTVSS/<u>GGGSGGGS</u>/EVQLVESGGGLVQPGGSLKLSCAAS<u>GFTF
NKYAIN</u>WVRQAPGKGLEWVA<u>RIRSKYNNYATYYADQVKD</u>RFTISRDDSKNTAYLQMNNLKTEDTAVYYCVR<u>HANFGNSYIS
YWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKF
LVP</u>GTPARFSGSLLGGKAALTLSGVQPEDEAEYYC<u>TLWYSNRWV</u>FGGGTKLTVL/<u>GGGSGGGS</u>/QVQLLESGGGLVQPGGSL
RLSCAAS<u>GRSFSRYGMG</u>WLRQAPGKERELVAS<u>ISWSGHSTYYADSVKG</u>RFTISRDNSKNTLYLQMNSLRAEDTAVYYCAA<u>ES
LPYESGSPRLTDFAS</u>WGQGTLVTVSS/*SGGPGPAGMKGLPGS*/QTVVTQEPSLTVSPGGTVTLTC<u>GSSTGAVTSGNYPN</u>WV
QQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>
/EVQLVESGGGLVQPGGSLKLSCAAS<u>GFTFNKYAMN</u>WVRQAPGKGLEWVA<u>RIRSKYDYKDDDDKADSVKD</u>RFTISRDDSKN
TAYLQMNNLKTEDTAVYYCVR<u>HGNFGNSYISYWAY</u>WGQGTLVTVSS/<u>GGGGSGGGS</u>/EVQLVESGGGLVQPGNSLRLSCAA
S<u>GFTFSKFGMS</u>WVRQAPGKGLEWVS<u>SISGSGRDTLYAESVKG</u>RFTISRDNAKTTLYLMNSLRPEDTAVYYCT<u>IGGSLS</u>VSSQ
GTLVTVSS/HHHHHH (SEQ ID NO:302)

Pro681 aTrop2 hVIB557 sdAb – aCD3 Vh (2B2) – NCL-8 – aCD3Vl (2B2) – aTrop2 hVIB557 sdAb – NCL-16 - aCD3Vli – NCL-8 - aCD3Vhi – aHSA (10GE) - His6

QVQLLESGGGLVQPGGSLRLSCAAS<u>GRTFSSQSMG</u>WFRQAPGKEREFVS<u>AISWTGANPTYADSVKG</u>RFTISRDNSKNTLYLQ
MNSLRAEDTAVYYCAA<u>DTSGGSYYYERATAETSYDY</u>WGQGTLVTVSS/<u>GGGSGGGS</u>/EVQLVESGGGLVQPGGSLKLSCAAS
<u>GFTFNKYAIN</u>WVRQAPGKGLEWVA<u>RIRSKYNNYATYYADQVKD</u>RFTISRDDSKNTAYLQMNNLKTEDTAVYYCVR<u>HANFG
NSYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG
<u>GTKFLVP</u>GTPARFSGSLLGGKAALTLSGVQPEDEAEYYC<u>TLWYSNRWV</u>FGGGTKLTVL/<u>GGGSGGGS</u>/QVQLLESGGGLVQP
GGSLRLSCAAS<u>GRTFSSQSMG</u>WFRQAPGKEREFVS<u>AISWTGANPTYADSVKG</u>RFTISRDNSKNTLYLQMNSLRAEDTAVYYC
AA<u>DTSGGSYYYERATAETSYDY</u>WGQGTLVTVSS/<u>GGGSGGGGSGGGGS</u>/QTVVTQEPSLTVSPGGTVTLTC<u>GSSTGAVTS
GNYPN</u>WVQQKPGQAPRGLIG<u>DYKDDDDK</u>GTPARFSGSLLGGKAALTLSGVQPEDEAEYYC<u>VLWYSNRWV</u>FGGGTKLTVL/
<u>GGGSGGGS</u>/EVQLVESGGGLVQPGGSLKLSCAAS<u>GFTFNKYAMN</u>WVRQAPGKGLEWVA<u>RIRSKYDYKDDDDKADSVKD</u>R
FTISRDDSKNTAYLQMNNLKTEDTAVYYCVR<u>HGNFGNSYISYWAY</u>WGQGTLVTVSS/<u>GGGSGGGS</u>/EVQLVESGGGLVQP
GNSLRLSCAAS<u>GFTFSKFGMS</u>WVRQAPGKGLEWVS<u>SISGSGRDTLYAESVKG</u>RFTISRDNAKTTLYLMNSLRPEDTAVYYCT
<u>IGGSLS</u>VSSQGTLVTVSS/HHHHHH (SEQ ID NO:303)

Figure 63N

<u>Pro621</u> aB7H3 hF7 sdAb – aCD3 Vh (2B2) – NCL-8 – aCD3VI (2B2) - aB7H3 hF7 sdAb

– CathS-16 - aCD3Vii – NCL-8 – aCD3Vhi – aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT FNKYAIN</u>WVRQAPGKGLEWVA<u>RIRSKYNNYATYYADQVKD</u>RFTISRDDSKNTAYLQMNNLKTEDTAVYYCVR<u>HANFGNSYI SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK FLVPGTPARFSGSLLGGKAALTLSGVQPEDEAEYYC<u>TLWYSNRWV</u>FGGGTKLTVL/<u>GGGSGGGS</u>/QVQLQESGGGLVQPGGS LRLSCAPS<u>RRTFHTYHMG</u>WFRQAPGKEREFVA<u>VINWSGGSTVYADSVKG</u>RFTISRDNSKNTLYLQMNSLRAEDTAVYYCAA <u>GGATTQRATEASYDY</u>WGQGTLVTVSS/<u>*GGGSARLQSAAPGGGS*</u>/QTVVTQEPSLTVSPGGTVTLTC<u>GSSTGAVTSGNYPN</u>W VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG S</u>/EVQLVESGGGLVQPGGSLKLSCAAS<u>GFTFNKYAMN</u>WVRQAPGKGLEWVA<u>RIRSKYDYKDDDDKADSVKD</u>RFTISRDDSK NTAYLQMNNLKTEDTAVYYCVR<u>HGNFGNSYISYWAY</u>WGQGTLVTVSS/<u>GGGSGGGS</u>/EVQLVESGGGLVQPGNSLRLSCA AS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>VSS QGTLVTVSS/HHHHHH (SEQ ID NO:304)

<u>Pro622</u> aB7H3 hF12 sdAb – aCD3 Vh (2B2) – NCL-8 – aCD3VI (2B2) - aB7H3 hF12 sdAb

– CathS-16 - aCD3Vii – NCL-8 – aCD3Vhi – aHSA (10GE) - His6

QVQLQESGGGLVQPGGSLRLSCEAS<u>PRTFSTYSMA</u>WFRQAPGKERSFVA<u>AINWSGGNTSYADSVKG</u>RFTISRDNSKNTLYLQ MNSLRAEDTAVYYCAA<u>GGVLAHHNYEYDY</u>WGQGTLVTVSS/<u>GGGSGGGS</u>/EVQLVESGGGLVQPGGSLKLSCAAS<u>GFTFNK YAIN</u>WVRQAPGKGLEWVA<u>RIRSKYNNYATYYADQVKD</u>RFTISRDDSKNTAYLQMNNLKTEDTAVYYCVR<u>HANFGNSYISY WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR LSCEAS<u>PRTFSTYSMA</u>WFRQAPGKERSFVA<u>AINWSGGNTSYADSVKG</u>RFTISRDNSKNTLYLQMNSLRAEDTAVYYCAA<u>GG VLAHHNYEYDY</u>WGQGTLVTVSS/<u>*GGGSARLQSAAPGGGS*</u>/QTVVTQEPSLTVSPGGTVTLTC<u>GSSTGAVTSGNYPN</u>WVQQ KPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>/EV QLVESGGGLVQPGGSLKLSCAAS<u>GFTFNKYAMN</u>WVRQAPGKGLEWVA<u>RIRSKYDYKDDDDKADSVKD</u>RFTISRDDSKNTA YLQMNNLKTEDTAVYYCVR<u>HGNFGNSYISYWAY</u>WGQGTLVTVSS/<u>GGGSGGGS</u>/EVQLVESGGGLVQPGNSLRLSCAAS<u>G FTFSKFGMS</u>WVRQAPGKGLEWVS<u>SISGSGRDTLYAESVKG</u>RFTISRDNAKTTLYLQMNSLRPEDTAVYYCT<u>GGSLS</u>VSSQGT LVTVSS/HHHHHH (SEQ ID NO:305)

Figure 63O

Pro640 aB7H3 hF7 sdAb – aCD3 Vh (2B2) – NCL-8 – aCD3Vl (2B2) - aB7H3 hF7 sdAb

– MMP9v - aCD3Vh – NCL-8 - aCD3Vhi – aHSA (10GE) - His6

QVQLQESGGGLVQPGGSLRLSCAPSRRTFHTYHMGWFRQAPGKEREFVAVINWSGGSTVYADSVKGRFTISRDNSKNTLYL
QMNSLRAEDTAVYYCAAGGATTQRATEASYDYWGQGTLVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVQLQESGGGLVQPGGS
LRLSCAPSRRTFHTYHMGWFRQAPGKEREFVAVINWSGGSTVYADSVKGRFTISRDNSKNTLYLQMNSLRAEDTAVYYCAA
GGATTQRATEASYDYWGQGTLVTVSS/GSGGPGPAGMHGLPGGS/QTVVTQEPSLTVSPGGTVTLTCGSSTGAVTSGNYPN
WVQQKPGQAPRGLIGDYKDDDDKGTPARFSGSLLGGKAALTLSGVQPEDEAEYYCVLWYSNRWVFGGGTKLTVL/GGGSG
GGS/EVQLVESGGGLVQPGGSLKLSCAASGFTFNKYAMNWVRQAPGKGLEWVARIRSKYDYKDDDDKADSVKDRFTISRD
DSKNTAYLQMNNLKTEDTAVYYCVRHGNFGNSYISYWAYWGQGTLVTVSS/GGGGSGGGS/EVQLVESGGGLVQPGNSLR
LSCAASGFTFSKFGMSWVRQAPGKGLEWVSSISGSGRDTLYAESVKGRFTISRDNAKTTLYLQMNSLRPEDTAVYYCTIGGSLS
VSSQGTLVTVSS/HHHHHH (SEQ ID NO:306)

Pro641 aB7H3 hF12 sdAb – aCD3 Vh (2B2) – NCL-8 – aCD3Vl (2B2) - aB7H3 hF12 sdAb

– MMP9v - aCD3Vh – NCL-8 - aCD3Vhi – aHSA (10GE) - His6

QVQLQESGGGLVQPGGSLRLSCEASPRTFSTYSMAWFRQAPGKERSFVAAINWSGGNTSYADSVKGRFTISRDNSKNTLYLQ
MNSLRAEDTAVYYCAAGVLAHHNYEYDYWGQGTLVTVSS/GGGSGGGS/EVQLVESGGGLVQPGGSLKLSCAASGFTFNK
YAINWVRQAPGKGLEWVARIRSKYNNYATYYADQVKDRFTISRDDSKNTAYLQMNNLKTEDTAVYYCVRHANFGNSYISY
WAYWGQGTLVTVSS/GGGSGGGS/QTVVTQEPSLTVSPGGTVTLTCASSTGAVTSGNYPNWVQQKPGQAPRGLIGGTKFL
VPGTPARFSGSLLGGKAALTLSGVQPEDEAEYYCTLWYSNRWVFGGGTKLTVL/GGGSGGGS/QVQLQESGGGLVQPGGSLR
LSCEASPRTFSTYSMAWFRQAPGKERSFVAAINWSGGNTSYADSVKGRFTISRDNSKNTLYLQMNSLRAEDTAVYYCAAGG
VLAHHNYEYDYWGQGTLVTVSS/GSGGPGPAGMHGLPGGS/QTVVTQEPSLTVSPGGTVTLTCGSSTGAVTSGNYPNWVQ
QKPGQAPRGLIGDYKDDDDKGTPARFSGSLLGGKAALTLSGVQPEDEAEYYCVLWYSNRWVFGGGTKLTVL/GGGSGGGS/
EVQLVESGGGLVQPGGSLKLSCAASGFTFNKYAMNWVRQAPGKGLEWVARIRSKYDYKDDDDKADSVKDRFTISRDDSKN
TAYLQMNNLKTEDTAVYYCVRHGNFGNSYISYWAYWGQGTLVTVSS/GGGGSGGGS/EVQLVESGGGLVQPGNSLRLSCAA
SGFTFSKFGMSWVRQAPGKGLEWVSSISGSGRDTLYAESVKGRFTISRDNAKTTLYLQMNSLRPEDTAVYYCTIGGSLSVSSQ
GTLVTVSS/HHHHHH (SEQ ID NO:307)

Figure 63P

Pro642 aB7H3 hF7 sdAb – aCD3 Vh (2B2) – NCL-8 – aCD3VI (2B2) - aB7H3 hF7 sdAb

– MMP9v - aCD3VIi2 – NCL-8 - aCD3Vhi2 – aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FL</u>VPGTPARFSGSLLGGKAALTLSGVQPEDEAEYYC<u>TLWYSNRWV</u>FGGGTKLTVL/<u>GGGSGGGS</u>/QVQLQESGGGLVQPGGS
LRLSCAPS<u>RRTFHTYHMG</u>WFRQAPGKEREFVA<u>VINWSGGSTVYADSVKG</u>RFTISRDNSKNTLYLQMNSLRAEDTAVYYCAA
<u>GGATTQRATEASYDY</u>WGQGTLVTVSS/*GSGGPGPAGMHGLPGGS*/QTVVTQEPSLTVSPGGTVTLTC<u>GSSTGAVTSGNYPN</u>
WVQQKPGQAPRGLIG<u>GTKDDAP</u>GTPARFSGSLLGGKAALTLSGVQPEDEAEYYC<u>VLWYSNRWV</u>FGGGTKLTVL/<u>GGGSGG</u>
<u>GS</u>/EVQLVESGGGLVQPGGSLKLSCAAS<u>GFTFNKHAMN</u>WVRQAPGKGLEWVA<u>RIRSKYNNYATAYADSVKD</u>RFTISRDDSK
NTAYLQMNNLKTEDTAVYYCVR<u>HGNFGNSYISYWAY</u>WGQGTLVTVSS/<u>GGGGSGGGS</u>/EVQLVESGGGLVQPGNSLRLSCA
AS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>VSS
QGTLVTVSS/HHHHHH (SEQ ID NO:308)

Pro643 aB7H3 hF12 sdAb – aCD3 Vh (2B2) – NCL-8 – aCD3VI (2B2) - aB7H3 hF12 sdAb

– MMP9v - aCD3VIi2 – NCL-8 - aCD3Vhi2 – aHSA (10GE) - His6

QVQLQESGGGLVQPGGSLRLSCEAS<u>PRTFSTYSMA</u>WFRQAPGKERSFVA<u>AINWSGGNTSYADSVKG</u>RFTISRDNSKNTLYLQ
MNSLRAEDTAVYYCAA<u>GVLAHHNYEYDY</u>WGQGTLVTVSS/<u>GGGSGGGS</u>/EVQLVESGGGLVQPGGSLKLSCAAS<u>GFTFNK</u>
<u>YAIN</u>WVRQAPGKGLEWVA<u>RIRSKYNNYATYYADQVKD</u>RFTISRDDSKNTAYLQMNNLKTEDTAVYYCVR<u>HANFGNSYISY</u>
<u>WAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFL</u>
<u>VP</u>GTPARFSGSLLGGKAALTLSGVQPEDEAEYYC<u>TLWYSNRWV</u>FGGGTKLTVL/<u>GGGSGGGS</u>/QVQLQESGGGLVQPGGSLR
LSCEAS<u>PRTFSTYSMA</u>WFRQAPGKERSFVA<u>AINWSGGNTSYADSVKG</u>RFTISRDNSKNTLYLQMNSLRAEDTAVYYCAA<u>GG</u>
<u>VLAHHNYEYDY</u>WGQGTLVTVSS/*GSGGPGPAGMHGLPGGS*/QTVVTQEPSLTVSPGGTVTLTC<u>GSSTGAVTSGNYPN</u>WVQ
QKPGQAPRGLIG<u>GTKDDAP</u>GTPARFSGSLLGGKAALTLSGVQPEDEAEYYC<u>VLWYSNRWV</u>FGGGTKLTVL/<u>GGGSGGGS</u>/EV
QLVESGGGLVQPGGSLKLSCAAS<u>GFTFNKHAMN</u>WVRQAPGKGLEWVA<u>RIRSKYNNYATAYADSVKD</u>RFTISRDDSKNTAYL
QMNNLKTEDTAVYYCVR<u>HGNFGNSYISYWAY</u>WGQGTLVTVSS/<u>GGGGSGGGS</u>/EVQLVESGGGLVQPGNSLRLSCAAS<u>GFT</u>
<u>FSKFGMS</u>WVRQAPGKGLEWVS<u>SISGSGRDTLYAESVKG</u>RFTISRDNAKTTLYLQMNSLRPEDTAVYYCT<u>GGSLS</u>VSSQGTLV
TVSS/HHHHHH (SEQ ID NO:309)

Figure 63Q

Pro744 aB7H3 hF7 sdAb – aCD3 Vh (2B2) – NCL-8 – aCD3Vl (2B2) – aB7H3 hF7 sdAb

– MMP9-15 (K->E) - aCD3VlI –NCL-8 - aCD3Vhi – aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLV</u>PGTPARFSGSLLGGKAALTLSGVQPEDEAEYYC<u>TLWYSNRWV</u>FGGGTKLTVL/<u>GGGSGGGS</u>/QVQLQESGGGLVQPGGS
LRLSCAPS<u>RRTFHTYHMG</u>WFRQAPGKEREFVA<u>VINWSGGSTVYADSVKG</u>RFTISRDNSKNTLYLQMNSLRAEDTAVYYCAA
<u>GGATTQRATEASYDY</u>WGQGTLVTVSS/*SGGPGPAGMEGLPGS*/QTVVTQEPSLTVSPGGTVTLTC<u>GSSTGAVTSGNYPNW</u>
VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG</u>
<u>S</u>/EVQLVESGGGLVQPGGSLKLSCAAS<u>GFTFNKYAMN</u>WVRQAPGKGLEWVA<u>RIRSKYDYKDDDDKADSVKD</u>RFTISRDDSK
NTAYLQMNNLKTEDTAVYYCVR<u>HGNFGNSYISYWAY</u>WGQGTLVTVSS/<u>GGGGSGGGS</u>/EVQLVESGGGLVQPGNSLRLSCA
AS<u>GFTFSKFGMS</u>WVRQAPGKGLEWVS<u>SISGSGRDTLYAESVKG</u>RFTISRDNAKTTLYLQMNSLRPEDTAVYYCT<u>GGSLSVSS</u>
QGTLVTVSS/HHHHHH (SEQ ID NO:310)

Pro746 haB7H3 F7 sdAb – aCD3 Vh (2B2) – NCL-8 – aCD3Vl (2B2) - haB7H3 F7 sdAb

– MMP9-15 (M->P) - aCD3Vll –NCL-8 - aCD3Vhi – aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLV</u>PGTPARFSGSLLGGKAALTLSGVQPEDEAEYYC<u>TLWYSNRWV</u>FGGGTKLTVL/<u>GGGSGGGS</u>/QVQLQESGGGLVQPGGS
LRLSCAPS<u>RRTFHTYHMG</u>WFRQAPGKEREFVA<u>VINWSGGSTVYADSVKG</u>RFTISRDNSKNTLYLQMNSLRAEDTAVYYCAA
<u>GGATTQRATEASYDY</u>WGQGTLVTVSS/*SGGPGPAGPKGLPGS*/QTVVTQEPSLTVSPGGTVTLTC<u>GSSTGAVTSGNYPNWV</u>
QQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>
/EVQLVESGGGLVQPGGSLKLSCAAS<u>GFTFNKYAMN</u>WVRQAPGKGLEWVA<u>RIRSKYDYKDDDDKADSVKD</u>RFTISRDDSKN
TAYLQMNNLKTEDTAVYYCVR<u>HGNFGNSYISYWAY</u>WGQGTLVTVSS/<u>GGGGSGGGS</u>/EVQLVESGGGLVQPGNSLRLSCAA
S<u>GFTFSKFGMS</u>WVRQAPGKGLEWVS<u>SISGSGRDTLYAESVKG</u>RFTISRDNAKTTLYLQMNSLRPEDTAVYYCT<u>GGSLSVSSQ</u>
GTLVTVSS/HHHHHH (SEQ ID NO:311)

Figure 63R

Pro638 aFOLR1 h77-2 sdAb – aCD3 Vh (2B2) – NCL-8 – aCD3Vl (2B2) – aFOLR1 h77-2 sdAb

– MMP9v - aCD3Vlī - NCL-8 - aCD3Vhi – aHSA (10GE) - His6

QVQLVESGGGLVQPGGSLRLSCAASGFTVSNSVMAWYRQTPGNEREFVAIINSIGITNYADSVKGRFTISRDNSKNTLYLQM
NSLRAEDTAVYYCNRNFDRIYWGQGTLVTVSS/GGGSGGGS/EVQLVESGGGLVQPGGSLKLSCAASGFTFNKYAINWVRQA
PGKGLEWVARIRSKYNNYATYYADQVKDRFTISRDDSKNTAYLQMNNLKTEDTAVYYCVRHANFGNSYISYWAYWGQGTL
VTVSS/GGGSGGGS/QTVVTQEPSLTVSPGGTVTLTCASSTGAVTSGNYPNWVQQKPGQAPRGLIGGTKFLVPGTPARFSGS
LLGGKAALTLSGVQPEDEAEYYCTLWYSNRWVFGGGTKLTVL/GGGSGGGS/QVQLVESGGGLVQPGGSLRLSCAASGFTVS
NSVMAWYRQTPGNEREFVAIINSIGITNYADSVKGRFTISRDNSKNTLYLQMNSLRAEDTAVYYCNRNFDRIYWGQGTLVTV
SS/GSGGPGPAGMHGLPGGS/QTVVTQEPSLTVSPGGTVTLTCGSSTGAVTSGNYPNWVQQKPGQAPRGLIGDYKDDDDK
GTPARFSGSLLGGKAALTLSGVQPEDEAEYYCVLWYSNRWVFGGGTKLTVL/GGGSGGGS/EVQLVESGGGLVQPGGSLKLS
CAASGFTFNKYAMNWVRQAPGKGLEWVARIRSKYDYKDDDDKADSVKDRFTISRDDSKNTAYLQMNNLKTEDTAVYYCVR
HGNFGNSYISYWAYWGQGTLVTVSS/GGGGSGGGS/EVQLVESGGGLVQPGNSLRLSCAASGFTFSKFGMSWVRQAPGKG
LEWVSSISGSGRDTLYAESVKGRFTISRDNAKTTLYLQMNSLRPEDTAVYYCTGGSLSVSSQGTLVTVSS/HHHHHH (SEQ ID
NO:312)

Pro639 aFOLR1 h59.3 sdAb – aCD3 Vh (2B2) – NCL-8 – aCD3Vl (2B2) – aFOLR1 h59.3 sdAb

– MMP9v - aCD3Vlī - NCL-8 - aCD3Vhi – aHSA (10GE) - His6

QVQLVESGGGLVQPGGSLRLSCAAPGNTFSISAMGWYRQAPGKQREWVAVTHSDYSTNYADSVKGRFTISRDNSKNTLYLQ
MNSLRAEDTAVYYCKHYGIDYWGQGTLVTVSS/GGGSGGGS/EVQLVESGGGLVQPGGSLKLSCAASGFTFNKYAINWVRQ
APGKGLEWVARIRSKYNNYATYYADQVKDRFTISRDDSKNTAYLQMNNLKTEDTAVYYCVRHANFGNSYISYWAYWGQGT
LVTVSS/GGGSGGGS/QTVVTQEPSLTVSPGGTVTLTCASSTGAVTSGNYPNWVQQKPGQAPRGLIGGTKFLVPGTPARFSG
SLLGGKAALTLSGVQPEDEAEYYCTLWYSNRWVFGGGTKLTVL/GGGSGGGS/QVQLVESGGGLVQPGGSLRLSCAAPGNTF
SISAMGWYRQAPGKQREWVAVTHSDYSTNYADSVKGRFTISRDNSKNTLYLQMNSLRAEDTAVYYCKHYGIDYWGQGTLV
TVSS/GSGGPGPAGMHGLPGGS/QTVVTQEPSLTVSPGGTVTLTCGSSTGAVTSGNYPNWVQQKPGQAPRGLIGDYKDDD
DKGTPARFSGSLLGGKAALTLSGVQPEDEAEYYCVLWYSNRWVFGGGTKLTVL/GGGSGGGS/EVQLVESGGGLVQPGGSLK
LSCAASGFTFNKYAMNWVRQAPGKGLEWVARIRSKYDYKDDDDKADSVKDRFTISRDDSKNTAYLQMNNLKTEDTAVYYC
VRHGNFGNSYISYWAYWGQGTLVTVSS/GGGGSGGGS/EVQLVESGGGLVQPGNSLRLSCAASGFTFSKFGMSWVRQAPG
KGLEWVSSISGSGRDTLYAESVKGRFTISRDNAKTTLYLQMNSLRPEDTAVYYCTGGSLSVSSQGTLVTVSS/HHHHHH (SEQ
ID NO:313)

Figure 63S

Pro396 aEGFR sdAb – aCD3 Vh (2B2) – NCL-8 – aCD3Vl (2B2) - aEGFR sdAb

– MMP9v-16 - aCD3Vlli – NCL-8 - aCD3Vhi – aHSA (10GE) - His6

QVKLEESGGGSVQTGGSLRLTCAAS<u>GRTSRSYGMG</u>WFRQAPGKEREFVS<u>GISWRGDSTGYADSVKG</u>RFTISRDNAKNTVDL
QMNSLKPEDTAIYYCAA<u>AAGSAWYGTLYEYDY</u>WGQGTQVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVP</u>GTPARFSGSLLGGKAALTLSGVQPEDEAEYYC<u>TLWYSNRWV</u>FGGGTKLTVL/<u>GGGSGGGS</u>/QVKLEESGGGSVQTGGSL
RLTCAAS<u>GRTSRSYGMG</u>WFRQAPGKEREFVS<u>GISWRGDSTGYADSVKG</u>RFTISRDNAKNTVDLQMNSLKPEDTAIYYCAA<u>A</u>
<u>AGSAWYGTLYEYDY</u>WGQGTQVTVSS/*GSGGPGPAGMHGLPGGS*/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSG</u>
<u>GGS</u>/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/<u>GGGSGGGS</u>/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>
VSSQGTLVTVSS/HHHHHH (SEQ ID NO:314)

Pro476 aEGFR sdAb – aCD3 Vh (2B2) – NCL-8 – aCD3Vl (2B2) - aEGFR sdAb

– MMP9-15 - aCD3Vli2 – NCL-8 - aCD3Vhi2 – aHSA (10GE) - His6

QVKLEESGGGSVQTGGSLRLTCAAS<u>GRTSRSYGMG</u>WFRQAPGKEREFVS<u>GISWRGDSTGYADSVKG</u>RFTISRDNAKNTVDL
QMNSLKPEDTAIYYCAA<u>AAGSAWYGTLYEYDY</u>WGQGTQVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVP</u>GTPARFSGSLLGGKAALTLSGVQPEDEAEYYC<u>TLWYSNRWV</u>FGGGTKLTVL/<u>GGGSGGGS</u>/QVKLEESGGGSVQTGGSL
RLTCAAS<u>GRTSRSYGMG</u>WFRQAPGKEREFVS<u>GISWRGDSTGYADSVKG</u>RFTISRDNAKNTVDLQMNSLKPEDTAIYYCAA<u>A</u>
<u>AGSAWYGTLYEYDY</u>WGQGTQVTVSS/*SGGPGPAGMKGLPGS*/QTVVTQEPSLTVSPGGTVTLTC<u>GSSTGAVTSGNYPN</u>WV
QQKPGQAPRGLIG<u>GTKDDAP</u>GTPARFSGSLLGGKAALTLSGVQPEDEAEYYC<u>VLWYSNRWV</u>FGGGTKLTVL/<u>GGGSGGGS</u>/
EVQLVESGGGLVQPGGSLKLSCAAS<u>GFTFNKHAMN</u>WVRQAPGKGLEWVA<u>RIRSKYNNYATAYADSVKD</u>RFTISRDDSKNT
AYLQMNNLKTEDTAVYYCVR<u>HGNFGNSYISYWAY</u>WGQGTLVTVSS/<u>GGGGSGGGS</u>/EVQLVESGGGLVQPGNSLRLSCAAS
<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>VSSQG
TLVTVSS/HHHHHH (SEQ ID NO:315)

Figure 63T

Pro706 aEGFR sdAb – aCD3 Vh (2B2) – NCL-8 – aCD3Vl (2B2) - aEGFR sdAb

– uPA - aCD3Vlı – NCL-8 – aCD3Vhi – aHSA (10GE) – His6

QVKLEESGGGSVQTGGSLRLTCAAS<u>GRTSRSYGMG</u>WFRQAPGKEREFVS<u>GISWRGDSTGYADSVK</u>GRFTISRDNAKNTVDL
QMNSLKPEDTAIYYCAA<u>AAGSAWYGTLYEYDY</u>WGQGTQVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVK</u>DRFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVPGTPARFSG</u>SLLGGKAALTLSGVQPEDEAEYYC<u>TLWYSNRWV</u>FGGGTKLTVL/<u>GGGSGGGS</u>/QVKLEESGGGSVQTGGSL
RLTCAAS<u>GRTSRSYGMG</u>WFRQAPGKEREFVS<u>GISWRGDSTGYADSVK</u>GRFTISRDNAKNTVDLQMNSLKPEDTAIYYCAA<u>A</u>
<u>AGSAWYGTLYEYDY</u>WGQGTQVTVSS/<u>GGSHTGRSAYFGGGS</u>/QTVVTQEPSLTVSPGGTVTLTC<u>GSSTGAVTSGNYPNW</u>
VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG</u>
<u>S</u>/EVQLVESGGGLVQPGGSLKLSCAAS<u>GFTFNKYAMN</u>WVRQAPGKGLEWVA<u>RIRSKYDYKDDDDKADSVK</u>DRFTISRDDSK
NTAYLQMNNLKTEDTAVYYCVR<u>HGNFGNSYISYWAY</u>WGQGTLVTVSS/<u>GGGGSGGGS</u>/EVQLVESGGGLVQPGNSLRLSCA
AS<u>GFTFSKFGMS</u>WVRQAPGKGLEWVS<u>SISGSGRDTLYAESVK</u>GRFTISRDNAKTTLYLQMNSLRPEDTAVYYCT<u>GGSLS</u>VSS
QGTLVTVSS/HHHHHH (SEQ ID NO:316)

Pro709 aEGFR sdAb – aCD3 Vh (2B2) – NCL-8 – aCD3Vl (2B2) - aEGFR sdAb

– MMP9-15 - aCD3Vlı – NCL-8 – aCD3Vhi – aHSA (10GE) - His6

EVQLVESGGGVVRPGGSLRLSCAAS<u>GRTSRSYGMG</u>WFRQAPGKEREFVS<u>GISWRGDSTGYADSVK</u>GRFTISRDNAKNSLYL
QMNSLRAEDTALYYCAA<u>AAGSAWYGTLYEYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVK</u>DRFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVPGTPARFSG</u>SLLGGKAALTLSGVQPEDEAEYYC<u>TLWYSNRWV</u>FGGGTKLTVL/<u>GGGSGGGS</u>/EVQLVESGGGVVRPGGS
LRLSCAAS<u>GRTSRSYGMG</u>WFRQAPGKEREFVS<u>GISWRGDSTGYADSVK</u>GRFTISRDNAKNSLYLQMNSLRAEDTALYYCAA<u>A</u>
<u>AGSAWYGTLYEYDY</u>WGQGTLVTVSS/<u>SGGPGPAGMKGLPGS</u>/QTVVTQEPSLTVSPGGTVTLTC<u>GSSTGAVTSGNYPN</u>WV
QQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>
/EVQLVESGGGLVQPGGSLKLSCAAS<u>GFTFNKYAMN</u>WVRQAPGKGLEWVA<u>RIRSKYDYKDDDDKADSVK</u>DRFTISRDDSKN
TAYLQMNNLKTEDTAVYYCVR<u>HGNFGNSYISYWAY</u>WGQGTLVTVSS/<u>GGGGSGGGS</u>/EVQLVESGGGLVQPGNSLRLSCAA
S<u>GFTFSKFGMS</u>WVRQAPGKGLEWVS<u>SISGSGRDTLYAESVK</u>GRFTISRDNAKTTLYLQMNSLRPEDTAVYYCT<u>GGSLS</u>VSSQ
GTLVTVSS/HHHHHH (SEQ ID NO:317)

Figure 63U

Pro470 aFOLR1 h77.2 sdAb – aCD3 Vh (2B2) – NCL-8 – aCD3Vl (2B2) - aEGFR sdAb

– MMP9-15 - aCD3Vll – NCL-8 - aCD3Vhi – aHSA (10GE) - His6

QVQLVESGGGLVQPGGSLRLSCAAS<u>GFTVSNSVMA</u>WYRQTPGNEREFVAI<u>INSIGITNYADSVK</u>GRFTISRDNSKNTLYLQM
NSLRAEDTAVYYCNR<u>NFDRIY</u>WGQGTLVTVSS/<u>GGGSGGGS</u>/EVQLVESGGGLVQPGGSLKLSCAAS<u>GFTFNKYAIN</u>WVRQA
PGKGLEWVA<u>RIRSKYNNYATYYADQVK</u>DRFTISRDDSKNTAYLQMNNLKTEDTAVYYCVR<u>HANFGNSYISYWAY</u>WGQGTL
VTVSS/<u>GGGSGGGS</u>/QTVVTQEPSLTVSPGGTVTLTC<u>ASSTGAVTSGNYPN</u>WVQQKPGQAPRGLIG<u>GTKFLV</u>PGTPARFSGS
LLGGKAALTLSGVQPEDEAEYYC<u>TLWYSNRWV</u>FGGGTKLTVL/<u>GGGSGGGS</u>/QVKLVESGGGVVRPGGSLTLSCAAS<u>GRTSR</u>
<u>SYGMG</u>WFRQAPGKEREFVS<u>GISWRGDSTGYADSVK</u>GRFTISRDNAKNSLYLQMNSLRAEDTALYYCAA<u>AAGSAWYGTLYE</u>
<u>YDY</u>WGQGTLVTVSS/<u>SGGPGPAGMKGLPGS</u>/QTVVTQEPSLTVSPGGTVTLTC<u>GSSTGAVTSGNYPN</u>WVQQKPGQAPRGLI
GDYKDDDDKGTPARFSGLLGGKAALTLSGVQPEDEAEYYC<u>VLWYSNRWV</u>FGGGTKLTVL/<u>GGGSGGGS</u>/EVQLVESGGGL
VQPGGSLKLSCAAS<u>GFTFNKYAMN</u>WVRQAPGKGLEWVA<u>RIRSKYDYKDDDDKADSVK</u>DRFTISRDDSKNTAYLQMNNLKT
EDTAVYYCVR<u>HGNFGNSYISYWAY</u>WGQGTLVTVSS/<u>GGGSGGGS</u>/EVQLVESGGGLVQPGNSLRLSCAAS<u>GFTFSKFGMS</u>
WVRQAPGKGLEWVS<u>SISGSGRDTLYAESVK</u>GRFTISRDNAKTTLYLQMNSLRPEDTAVYYCT<u>IGGSLS</u>VSSQGTLVTVSS/HHH
HHH (SEQ ID NO:318)

Pro471 aEGFR sdAb – aCD3 Vh (2B2) – NCL-8 – aCD3Vl (2B2) - aFOLR1 h77.2 sdAb

– MMP9-15 - aCD3Vll – NCL-8 - aCD3Vhi – aHSA (10GE) - His6

QVKLVESGGGVVRPGGSLTLSCAAS<u>GRTSRSYGMG</u>WFRQAPGKEREFVS<u>GISWRGDSTGYADSVK</u>GRFTISRDNAKNSLYL
QMNSLRAEDTALYYCAA<u>AAGSAWYGTLYEYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVK</u>DRFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLV</u>PGTPARFSGSLLGGKAALTLSGVQPEDEAEYYC<u>TLWYSNRWV</u>FGGGTKLTVL/<u>GGGSGGGS</u>/QVQLVESGGGLVQPGGS
LRLSCAAS<u>GFTVSNSVMA</u>WYRQTPGNEREFVAI<u>INSIGITNYADSVK</u>GRFTISRDNSKNTLYLQMNSLRAEDTAVYYCNR<u>NFD</u>
<u>RIY</u>WGQGTLVTVSS/<u>SGGPGPAGMKGLPGS</u>/QTVVTQEPSLTVSPGGTVTLTC<u>GSSTGAVTSGNYPN</u>WVQQKPGQAPRGLI
GDYKDDDDKGTPARFSGLLGGKAALTLSGVQPEDEAEYYC<u>VLWYSNRWV</u>FGGGTKLTVL/<u>GGGSGGGS</u>/EVQLVESGGGL
VQPGGSLKLSCAAS<u>GFTFNKYAMN</u>WVRQAPGKGLEWVA<u>RIRSKYDYKDDDDKADSVK</u>DRFTISRDDSKNTAYLQMNNLKT
EDTAVYYCVR<u>HGNFGNSYISYWAY</u>WGQGTLVTVSS/<u>GGGSGGGS</u>/EVQLVESGGGLVQPGNSLRLSCAAS<u>GFTFSKFGMS</u>
WVRQAPGKGLEWVS<u>SISGSGRDTLYAESVK</u>GRFTISRDNAKTTLYLQMNSLRPEDTAVYYCT<u>IGGSLS</u>VSSQGTLVTVSS/HHH
HHH (SEQ ID NO:319)

Figure 63V

Pro551

EGFR sdAb – aCD3 Vh (2B2) – NCL-8 – aCD3Vl (2B2) – aFOLR1 h59.3 sdAb

– MMP9-16 - aCD3Vli – NCL-8 - aCD3Vhi – aHSA (10GE) - His6

QVKLEESGGGSVQTGGSLRLTCAAS<u>GRTSRSYGMG</u>WFRQAPGKEREFVS<u>GISWRGDSTGYADSVKG</u>RFTISRDNAKNTVDL
QMNSLKPEDTAIYYCAA<u>AAGSAWYGTLYEYDY</u>WGQGTQVTVSS/*GGGSGGGS*/EVQLVESGGGLVQPGGSLKLSCAAS<u>GFT
FNKYAIN</u>WVRQAPGKGLEWVA<u>RIRSKYNNYATYYADQVKD</u>RFTISRDDSKNTAYLQMNNLKTEDTAVYYCVR<u>HANFGNSYI
SYWAY</u>WGQGTLVTVSS/*GGGSGGGS*/QTVVTQEPSLTVSPGGTVTLTC<u>ASSTGAVTSGNYPN</u>WVQQKPGQAPRGLIG<u>GTK
FLVP</u>GTPARFSGSLLGGKAALTLSGVQPEDEAEYYC<u>TLWYSNRWV</u>FGGGTKLTVL/*GGGSGGGS*/QVQLVESGGGLVQPGGS
LRLSCAAP<u>GNTFSISAMG</u>WYRQAPGKQREWVA<u>VTHSDYSTNYADSVKG</u>RFTISRDNSKNTLYLQMNSLRAEDTAVYYCKH<u>Y
GIDY</u>WGQGTLVTVSS/*SGGPGPAGMKGLPGS*/QTVVTQEPSLTVSPGGTVTLTC<u>GSSTGAVTSGNYPN</u>WVQQKPGQAPRG
LIG<u>DYKDDDDK</u>GTPARFSGSLLGGKAALTLSGVQPEDEAEYYC<u>VLWYSNRWV</u>FGGGTKLTVL/*GGGSGGGS*/EVQLVESGGG
LVQPGGSLKLSCAAS<u>GFTFNKYAMN</u>WVRQAPGKGLEWVA<u>RIRSKYDYKDDDDKADSVKD</u>RFTISRDDSKNTAYLQMNNLK
TEDTAVYYCVR<u>HGNFGNSYISYWAY</u>WGQGTLVTVSS/*GGGSGGGS*/EVQLVESGGGLVQPGNSLRLSCAAS<u>GFTFSKFGM</u>
SWVRQAPGKGLEWVS<u>SISGSGRDTLYAESVKG</u>RFTISRDNAKTTLYLQMNSLRPEDTAVYYCT<u>GGSLS</u>VSSQGTLVTVSS/HH
HHHH (SEQ ID NO:320)

Pro552 aFOLR1 h59.3 sdAb – aCD3 Vh (2B2) – NCL-8 – aCD3Vl (2B2) – EGFR sdAb

– MMP9-15 - aCD3Vli – NCL-8 - aCD3Vhi – aHSA (10GE) - His6

QVQLVESGGGLVQPGGSLRLSCAAP<u>GNTFSISAMG</u>WYRQAPGKQREWVA<u>VTHSDYSTNYADSVKG</u>RFTISRDNSKNTLYLQ
MNSLRAEDTAVYYCKH<u>YGIDY</u>WGQGTLVTVSS/*GGGSGGGS*/EVQLVESGGGLVQPGGSLKLSCAAS<u>GFTFNKYAIN</u>WVRQ
APGKGLEWVA<u>RIRSKYNNYATYYADQVKD</u>RFTISRDDSKNTAYLQMNNLKTEDTAVYYCVR<u>HANFGNSYISYWAY</u>WGQGT
LVTVSS/*GGGSGGGS*/QTVVTQEPSLTVSPGGTVTLTC<u>ASSTGAVTSGNYPN</u>WVQQKPGQAPRGLIG<u>GTKFLVP</u>GTPARFSG
SLLGGKAALTLSGVQPEDEAEYYC<u>TLWYSNRWV</u>FGGGTKLTVL/*GGGSGGGS*/QVKLEESGGGSVQTGGSLRLTCAAS<u>GRTS
RSYGMG</u>WFRQAPGKEREFVS<u>GISWRGDSTGYADSVKG</u>RFTISRDNAKNTVDLQMNSLKPEDTAIYYCAA<u>AAGSAWYGTLY
EYDY</u>WGQGTQVTVSS/*SGGPGPAGMKGLPGS*/QTVVTQEPSLTVSPGGTVTLTC<u>GSSTGAVTSGNYPN</u>WVQQKPGQAPRG
LIG<u>DYKDDDDK</u>GTPARFSGSLLGGKAALTLSGVQPEDEAEYYC<u>VLWYSNRWV</u>FGGGTKLTVL/*GGGSGGGS*/EVQLVESGGG
LVQPGGSLKLSCAAS<u>GFTFNKYAMN</u>WVRQAPGKGLEWVA<u>RIRSKYDYKDDDDKADSVKD</u>RFTISRDDSKNTAYLQMNNLK
TEDTAVYYCVR<u>HGNFGNSYISYWAY</u>WGQGTLVTVSS/*GGGSGGGS*/EVQLVESGGGLVQPGNSLRLSCAAS<u>GFTFSKFGM</u>
SWVRQAPGKGLEWVS<u>SISGSGRDTLYAESVKG</u>RFTISRDNAKTTLYLQMNSLRPEDTAVYYCT<u>GGSLS</u>VSSQGTLVTVSS/HH
HHHH (SEQ ID NO:321)

Figure 63W

Pro623 aEGFR sdAb – aCD3 Vh (2B2) – NCL-8 – aCD3Vl (2B2) – acEpCAM hVIB664 sdAb

– MMP9-15 - aCD3Vli – NCL-8 - aCD3Vhi – aHSA (10GE) - His6

QVKLVESGGGVVRPGGSLTLSCAASGRTSRSYGMGWFRQAPGKEREFVSGISWRGDSTGYADSVKGRFTISRDNAKNSLYL
QMNSLRAEDTALYYCAAAAGSAWYGTLYEYDYWGQGTLVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVQLLESGGGLVQPGGS
LRLSCAASGRTLDNYDMGWFRQGPGKEREFVAAISWSGGSTDYAYSVKGRFTISRDNSKNTLYLQMNSLRAEDTAVYYCAA
DLRFTGGDTMTPETYDYWGQGTLVTVSS/SGGPGPAGMKGLPGS/QTVVTQEPSLTVSPGGTVTLTCGSSTGAVTSGNYPN
WVQQKPGQAPRGLIGDYKDDDDKGTPARFSGSLLGGKAALTLSGVQPEDEAEYYCVLWYSNRWVFGGGTKLTVL/GGGSG
GGS/EVQLVESGGGLVQPGGSLKLSCAASGFTFNKYAMNWVRQAPGKGLEWVARIRSKYDYKDDDDKADSVKDRFTISRD
DSKNTAYLQMNNLKTEDTAVYYCVRHGNFGNSYISYWAYWGQGTLVTVSS/GGGSGGGS/EVQLVESGGGLVQPGNSLR
LSCAASGFTFSKFGMSWVRQAPGKGLEWVSSISGSGRDTLYAESVKGRFTISRDNAKTTLYLQMNSLRPEDTAVYYCTIGGSLS
VSSQGTLVTVSS/HHHHHH (SEQ ID NO:322)

Pro624 aEGFR sdAb – aCD3 Vh (2B2) – NCL-8 – aCD3Vl (2B2) – acEpCAM hVIB665 sdAb

– MMP9-15 - aCD3Vli – NCL-8 - aCD3Vhi – aHSA (10GE) - His6

QVKLVESGGGVVRPGGSLTLSCAASGRTSRSYGMGWFRQAPGKEREFVSGISWRGDSTGYADSVKGRFTISRDNAKNSLYL
QMNSLRAEDTALYYCAAAAGSAWYGTLYEYDYWGQGTLVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVQLLESGGGLVQPGGS
LRLSCAASGRTFSDYDMGWFRQGPGKEREFVAAISWSGGHTNYADSVKGRFTISRDNSKNTLYLQMNSLRAEDTAVYYCAA
DLRFTGGDTTTPETYDYWGQGTLVTVSS/SGGPGPAGMKGLPGS/QTVVTQEPSLTVSPGGTVTLTCGSSTGAVTSGNYPN
WVQQKPGQAPRGLIGDYKDDDDKGTPARFSGSLLGGKAALTLSGVQPEDEAEYYCVLWYSNRWVFGGGTKLTVL/GGGSG
GGS/EVQLVESGGGLVQPGGSLKLSCAASGFTFNKYAMNWVRQAPGKGLEWVARIRSKYDYKDDDDKADSVKDRFTISRD
DSKNTAYLQMNNLKTEDTAVYYCVRHGNFGNSYISYWAYWGQGTLVTVSS/GGGSGGGS/EVQLVESGGGLVQPGNSLR
LSCAASGFTFSKFGMSWVRQAPGKGLEWVSSISGSGRDTLYAESVKGRFTISRDNAKTTLYLQMNSLRPEDTAVYYCTIGGSLS
VSSQGTLVTVSS/HHHHHH (SEQ ID NO:323)

Figure 63X

Pro698 acEpCAM hVIB665 sdAb – aCD3 Vh (2B2) – NCL-8 – aCD3Vl (2B2) – aEGFR sdAb

– MMP9-15 - aCD3Vli – NCL-8 - aCD3Vhi – aHSA (10GE) - His6

QVQLLESGGGLVQPGGSLRLSCAAS<u>GRTFSDYDMG</u>WFRQGPGKEREFVA<u>AISWSGGHTNYADSVKG</u>RFTISRDNSKNTLYL
QMNSLRAEDTAVYYCAA<u>DLRFTGGDTTTPETYDY</u>WGQGTLVTVSS/<u>GGGSGGGS</u>/EVQLVESGGGLVQPGGSLKLSCAAS<u>GF
TFNKYAIN</u>WVRQAPGKGLEWVA<u>RIRSKYNNYATYYADQVKD</u>RFTISRDDSKNTAYLQMNNLKTEDTAVYYCVR<u>HANFGNS
YISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GT
KFLVPG</u>TPARFSGSLLGGKAALTLSGVQPEDEAEYYC<u>TLWYSNRWV</u>FGGGTKLTVL/<u>GGGSGGGS</u>/QVKLVESGGGVVRPGG
SLTLSCAAS<u>GRTSRSYGMG</u>WFRQAPGKEREFVS<u>GISWRGDSTGYADSVKG</u>RFTISRDNAKNSLYLQMNSLRAEDTALYYCAA
<u>AAGSAWYGTLYEYDY</u>WGQGTLVTVSS/*<u>SGGPGPAGMKGLPGS</u>*/QTVVTQEPSLTVSPGGTVTLTC<u>GSSTGAVTSGNYPN</u>W
VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG
S</u>/EVQLVESGGGLVQPGGSLKLSCAAS<u>GFTFNKYAMN</u>WVRQAPGKGLEWVA<u>RIRSKYDYKDDDDKADSVKD</u>RFTISRDDSK
NTAYLQMNNLKTEDTAVYYCVR<u>HGNFGNSYISYWAY</u>WGQGTLVTVSS/<u>GGGGSGGGS</u>/EVQLVESGGGLVQPGNSLRLSCA
AS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>VSS
QGTLVTVSS/HHHHHH (SEQ ID NO:324)

Pro655 aB7H3 hF7 sdAb – aCD3 Vh (2B2) – NCL-8 – aCD3Vl (2B2) – acEpCAM hVIB664 sdAb

– MMP9-15 - aCD3Vli – NCL-8 - aCD3Vhi – aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT
FNKYAIN</u>WVRQAPGKGLEWVA<u>RIRSKYNNYATYYADQVKD</u>RFTISRDDSKNTAYLQMNNLKTEDTAVYYCVR<u>HANFGNSYI
SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK
FLVPG</u>TPARFSGSLLGGKAALTLSGVQPEDEAEYYC<u>TLWYSNRWV</u>FGGGTKLTVL/<u>GGGSGGGS</u>/QVQLLESGGGLVQPGGS
LRLSCAAS<u>GRTLDNYDMG</u>WFRQGPGKEREFVA<u>AISWSGGSTDYAYSVKG</u>RFTISRDNSKNTLYLQMNSLRAEDTAVYYCAA
<u>DLRFTGGDTMTPETYDY</u>WGQGTLVTVSS/*<u>SGGPGPAGMKGLPGS</u>*/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSG
GGS</u>/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/<u>GGGGSGGGS</u>/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>GGSLS</u>
VSSQGTLVTVSS/HHHHHH (SEQ ID NO:325)

Figure 63Y

Pro656 aB7H3 hF7 sdAb – aCD3 Vh (2B2) – NCL-8 – aCD3Vl (2B2) – acEpCAM hVlB665 sdAb

– MMP9-15 - aCD3Vli - NCL-8 - aCD3Vhi - aHSA (10GE) - His6

QVQLQESGGGLVQPGGSLRLSCAPS<u>RRTFHTYHMG</u>WFRQAPGKEREFVA<u>VINWSGGSTVYADSVKG</u>RFTISRDNSKNTLYL
QMNSLRAEDTAVYYCAA<u>GGATTQRATEASYDY</u>WGQGTLVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLV</u>PGTPARFSGSLLGGKAALTLSGVQPEDEAEYYC<u>TLWYSNRWV</u>FGGGTKLTVL/<u>GGGSGGGS</u>/QVQLLESGGGLVQPGGS
LRLSCAAS<u>GRTFSDYDMG</u>WFRQGPGKEREFVA<u>AISWSGGHTNYADSVKG</u>RFTISRDNSKNTLYLQMNSLRAEDTAVYYCAA
<u>DLRFTGGDTTTPETYDY</u>WGQGTLVTVSS/<u>SGGPGPAGMKGLPGS</u>/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSG</u>
<u>GGS</u>/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/<u>GGGGSGGGS</u>/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>
VSSQGTLVTVSS/HHHHHH (SEQ ID NO:326)

Pro657 acEpCAM hVlB664 sdAb – aCD3 Vh (2B2) – NCL-8 – aCD3Vl (2B2) - haB7H3 F7 sdAb

– MMP9-15 - aCD3Vli - NCL-8 - aCD3Vhi - aHSA (10GE) - His6

QVQLLESGGGLVQPGGSLRLSCAAS<u>GRTLDNYDMG</u>WFRQGPGKEREFVA<u>AISWSGGSTDYAYSVKG</u>RFTISRDNSKNTLYL
QMNSLRAEDTAVYYCAA<u>DLRFTGGDTMTPETYDY</u>WGQGTLVTVSS/<u>GGGSGGGS</u>/EVQLVESGGGLVQPGGSLKLSCAAS<u>G</u>
<u>FTFNKYAIN</u>WVRQAPGKGLEWVA<u>RIRSKYNNYATYYADQVKD</u>RFTISRDDSKNTAYLQMNNLKTEDTAVYYCVR<u>HANFGN</u>
<u>SYISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>G</u>
<u>TKFLV</u>PGTPARFSGSLLGGKAALTLSGVQPEDEAEYYC<u>TLWYSNRWV</u>FGGGTKLTVL/<u>GGGSGGGS</u>/QVQLQESGGGLVQPG
GSLRLSCAPS<u>RRTFHTYHMG</u>WFRQAPGKEREFVA<u>VINWSGGSTVYADSVKG</u>RFTISRDNSKNTLYLQMNSLRAEDTAVYYC
AA<u>GGATTQRATEASYDY</u>WGQGTLVTVSS/<u>SGGPGPAGMKGLPGS</u>/QTVVTQEPSLTVSPGGTVTLTC<u>GSSTGAVTSGNYPN</u>
WVQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSG</u>
<u>GGS</u>/EVQLVESGGGLVQPGGSLKLSCAAS<u>GFTFNKYAMN</u>WVRQAPGKGLEWVA<u>RIRSKYDYKDDDDKADSVKD</u>RFTISRD
DSKNTAYLQMNNLKTEDTAVYYCVR<u>HGNFGNSYISYWAY</u>WGQGTLVTVSS/<u>GGGGSGGGS</u>/EVQLVESGGGLVQPGNSLR
LSCAAS<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>
VSSQGTLVTVSS/HHHHHH (SEQ ID NO327:)

Figure 63Z

Pro658 acEpCAM hVIB665 sdAb – aCD3 Vh (2B2) – NCL-8 – aCD3Vl (2B2) - haB7H3 F7 sdAb

– MMP9-15 - aCD3Vll – NCL-8 - aCD3Vhl – aHSA (10GE) - His6

QVQLLESGGGLVQPGGSLRLSCAAS<u>GRTFSDYDMG</u>WFRQGPGKEREFVA<u>AISWSGGHTNYADSVKG</u>RFTISRDNSKNTLYL
QMNSLRAEDTAVYYCAA<u>DLRFTGGDTTTPETYDY</u>WGQGTLVTVSS/<u>GGGSGGGS</u>/EVQLVESGGGLVQPGGSLKLSCAAS<u>GF
TFNKYAIN</u>WVRQAPGKGLEWVA<u>RIRSKYNNYATYYADQVKD</u>RFTISRDDSKNTAYLQMNNLKTEDTAVYYCVR<u>HANFGNS
YISYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GT
KFLVP</u>GTPARFSGSLLGGKAALTLSGVQPEDEAEYYC<u>TLWYSNRWV</u>FGGGTKLTVL/<u>GGGSGGGS</u>/QVQLQESGGGLVQPGG
SLRLSCAPS<u>RRTFHTYHMG</u>WFRQAPGKEREFVA<u>VINWSGGSTVYADSVKG</u>RFTISRDNSKNTLYLQMNSLRAEDTAVYYCAA
<u>GGATTQRATEASYDY</u>WGQGTLVTVSS/<u>SGGPGPAGMKGLPGS</u>/QTVVTQEPSLTVSPGGTVTLTC<u>GSSTGAVTSGNYPNW</u>
VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG
S</u>/EVQLVESGGGLVQPGGSLKLSCAAS<u>GFTFNKYAMN</u>WVRQAPGKGLEWVA<u>RIRSKYDYKDDDDKADSVKD</u>RFTISRDDSK
NTAYLQMNNLKTEDTAVYYCVR<u>HGNFGNSYISYWAY</u>WGQGTLVTVSS/<u>GGGSGGGS</u>/EVQLVESGGGLVQPGNSLRLSCA
AS<u>GFTFSKFGMS</u>WVRQAPGKGLEWVS<u>SISGSGRDTLYAESVKG</u>RFTISRDNAKTTLYLQMNSLRPEDTAVYYCT<u>IGGSLS</u>VSS
QGTLVTVSS/HHHHHH (SEQ ID NO:328)

Pro516 aCA9 hVIB456 sdAb – aCD3 Vh (2B2) – NCL-8 – aCD3Vl (2B2) – aCA9 hVIB456 sdAb

– MMP9-15 - aCD3Vll - NCL-8 - aCD3Vhl – aHSA (10GE) - His6

QVQLVESGGGLVQPGGSLRLSCAAS<u>GSALIINAMG</u>WYRQAPGKQRELVA<u>TVTRSGRTNYADSVKG</u>RFTISRDNSKNTLYLQ
MNSLRAEDTAVYYCNV<u>ALWIADGEYDY</u>WGQGTLVTVSS/<u>GGGSGGGS</u>/EVQLVESGGGLVQPGGSLKLSCAAS<u>GFTFNKYA
IN</u>WVRQAPGKGLEWVA<u>RIRSKYNNYATYYADQVKD</u>RFTISRDDSKNTAYLQMNNLKTEDTAVYYCVR<u>HANFGNSYISYWA
Y</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTKFLVP</u>G
TPARFSGSLLGGKAALTLSGVQPEDEAEYYC<u>TLWYSNRWV</u>FGGGTKLTVL/<u>GGGSGGGS</u>/QVQLVESGGGLVQPGGSLRLSC
AAS<u>GSALIINAMG</u>WYRQAPGKQRELVA<u>TVTRSGRTNYADSVKG</u>RFTISRDNSKNTLYLQMNSLRAEDTAVYYCNV<u>ALWIAD
GEYDY</u>WGQGTLVTVSS/<u>SGGPGPAGMKGLPGS</u>/QTVVTQEPSLTVSPGGTVTLTC<u>GSSTGAVTSGNYPN</u>WVQQKPGQAPR
GLIG<u>DYKDDDDK</u>GTPARFSGSLLGGKAALTLSGVQPEDEAEYYC<u>VLWYSNRWV</u>FGGGTKLTVL/<u>GGGSGGGS</u>/EVQLVESGG
GLVQPGGSLKLSCAAS<u>GFTFNKYAMN</u>WVRQAPGKGLEWVA<u>RIRSKYDYKDDDDKADSVKD</u>RFTISRDDSKNTAYLQMNNL
KTEDTAVYYCVR<u>HGNFGNSYISYWAY</u>WGQGTLVTVSS/<u>GGGSGGGS</u>/EVQLVESGGGLVQPGNSLRLSCAAS<u>GFTFSKFG
MS</u>WVRQAPGKGLEWVS<u>SISGSGRDTLYAESVKG</u>RFTISRDNAKTTLYLQMNSLRPEDTAVYYCT<u>IGGSLS</u>VSSQGTLVTVSS/
HHHHHH (SEQ ID NO:329)

Figure 63AA

Pro517 aCA9 hVIB476 sdAb – aCD3 Vh (2B2) – NCL-8 – aCD3VI (2B2) – aCA9 hVIB476 sdAb

– MMP9-15 - aCD3VIi – NCL-8 – aCD3Vhi – aHSA (10GE) - His6

QVQLVESGGGLVQPGGSLRLSCAAS<u>GNIFIINVMG</u>WYRQAPGKQRELVA<u>TITNGGRTHYADSVKG</u>RFTISRDNSKNTLYLQM
NSLRAEDTAVYYCNA<u>NHIELGDY</u>WGQGTLVTVSS/<u>GGGSGGGS</u>/EVQLVESGGGLVQPGGSLKLSCAAS<u>GFTFNKYAIN</u>WVR
QAPGKGLEWVA<u>RIRSKYNNYATYYADQVKD</u>RFTISRDDSKNTAYLQMNNLKTEDTAVYYCVR<u>HANFGNSYISYWAY</u>WGQ
GTLVTVSS/<u>GGGSGGGS</u>/QTVVTQEPSLTVSPGGTVTLTC<u>ASSTGAVTSGNYPN</u>WVQQKPGQAPRGLIG<u>GTKFLVP</u>GTPARF
SGSLLGGKAALTLSGVQPEDEAEYYC<u>TLWYSNRWV</u>FGGGTKLTVL/<u>GGGSGGGS</u>/QVQLVESGGGLVQPGGSLRLSCAAS<u>GN</u>
<u>IFIINVMG</u>WYRQAPGKQRELVA<u>TITNGGRTHYADSVKG</u>RFTISRDNSKNTLYLQMNSLRAEDTAVYYCNA<u>NHIELGDY</u>WGQ
GTLVTVSS/<u>SGGPGPAGMKGLPGS</u>/QTVVTQEPSLTVSPGGTVTLTC<u>GSSTGAVTSGNYPN</u>WVQQKPGQAPRGLIG<u>DYKDD</u>
<u>DDK</u>GTPARFSGSLLGGKAALTLSGVQPEDEAEYYC<u>VLWYSNRWV</u>FGGGTKLTVL/<u>GGGSGGGS</u>/EVQLVESGGGLVQPGGSL
KLSCAAS<u>GFTFNKYAMN</u>WVRQAPGKGLEWVA<u>RIRSKYDYKDDDDKADSVKD</u>RFTISRDDSKNTAYLQMNNLKTEDTAVYY
CVR<u>HGNFGNSYISYWAY</u>WGQGTLVTVSS/<u>GGGSGGGS</u>/EVQLVESGGGLVQPGNSLRLSCAAS<u>GFTFSKFGMS</u>WVRQAP
GKGLEWVS<u>SISGSGRDTLYAESVKG</u>RFTISRDNAKTTLYLQMNSLRPEDTAVYYCT<u>GGSLS</u>VSSQGTLVTVSS/HHHHHH
(SEQ ID NO:330)

Pro518 aCA9 hVIB407 sdAb – aCD3 Vh (2B2) – NCL-8 – aCD3VI (2B2) – aCA9 hVIB407 sdAb

– MMP9-15 - aCD3VIi – NCL-8 – aCD3Vhi – aHSA (10GE) - His6

QVQLVESGGGLVQPGGSLRLSCTAS<u>GIIFSVYDMG</u>WYRQTPGKQREFVA<u>RITAGGGTYLTDSVKG</u>RFTISRDNSKNTLYLQM
NSLRAEDTGVYYCNA<u>AWIGDDY</u>WGQGTLVTVSS/<u>GGGSGGGS</u>/EVQLVESGGGLVQPGGSLKLSCAAS<u>GFTFNKYAIN</u>WVR
QAPGKGLEWVA<u>RIRSKYNNYATYYADQVKD</u>RFTISRDDSKNTAYLQMNNLKTEDTAVYYCVR<u>HANFGNSYISYWAY</u>WGQ
GTLVTVSS/<u>GGGSGGGS</u>/QTVVTQEPSLTVSPGGTVTLTC<u>ASSTGAVTSGNYPN</u>WVQQKPGQAPRGLIG<u>GTKFLVP</u>GTPARF
SGSLLGGKAALTLSGVQPEDEAEYYC<u>TLWYSNRWV</u>FGGGTKLTVL/<u>GGGSGGGS</u>/QVQLVESGGGLVQPGGSLRLSCTAS<u>GII</u>
<u>FSVYDMG</u>WYRQTPGKQREFVA<u>RITAGGGTYLTDSVKG</u>RFTISRDNSKNTLYLQMNSLRAEDTGVYYCNA<u>AWIGDDY</u>WGQ
GTLVTVSS/<u>SGGPGPAGMKGLPGS</u>/QTVVTQEPSLTVSPGGTVTLTC<u>GSSTGAVTSGNYPN</u>WVQQKPGQAPRGLIG<u>DYKDD</u>
<u>DDK</u>GTPARFSGSLLGGKAALTLSGVQPEDEAEYYC<u>VLWYSNRWV</u>FGGGTKLTVL/<u>GGGSGGGS</u>/EVQLVESGGGLVQPGGSL
KLSCAAS<u>GFTFNKYAMN</u>WVRQAPGKGLEWVA<u>RIRSKYDYKDDDDKADSVKD</u>RFTISRDDSKNTAYLQMNNLKTEDTAVYY
CVR<u>HGNFGNSYISYWAY</u>WGQGTLVTVSS/<u>GGGSGGGS</u>/EVQLVESGGGLVQPGNSLRLSCAAS<u>GFTFSKFGMS</u>WVRQAP
GKGLEWVS<u>SISGSGRDTLYAESVKG</u>RFTISRDNAKTTLYLQMNSLRPEDTAVYYCT<u>GGSLS</u>VSSQGTLVTVSS/HHHHHH.
(SEQ ID NO:331)

Figure 63BB

Pro519 aCA9 hVIB445 sdAb – aCD3 Vh (2B2) – NCL-8 – aCD3Vl (2B2) – aCA9 hVIB445 sdAb

– MMP9-15 - aCD3Vli – NCL-8 - aCD3Vhi – aHSA (10GE) - His6

QVQLVESGGGLVKPGGSLRLSCAASGITFNLHAMRWYRRAPGKQRELVAYISARDWTNYADSVKGRFTISRDNAKNSLYLQ
MNSLRAEDTAVYYCNTDLVGEDYWGRGTLVTVSS/GGSGGGS/EVQLVESGGGLVQPGGSLKLSCAASGFTFNKYAINWV
RQAPGKGLEWVARIRSKYNNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQAPRGLIGGTKFLVPGTPARF
SGSLLGGKAALTLSGVQPEDEAEYYCTLWYSNRWVFGGGTKLTVL/GGGSGGGS/QVQLVESGGGLVKPGGSLRLSCAASGIT
FNLHAMRWYRRAPGKQRELVAYISARDWTNYADSVKGRFTISRDNAKNSLYLQMNSLRAEDTAVYYCNTDLVGEDYWGR
GTLVTVSS/SGGPGPAGMKGLPGS/QTVVTQEPSLTVSPGGTVTLTCGSSTGAVTSGNYPNWVQQKPGQAPRGLIGDYKDD
DDKGTPARFSGSLLGGKAALTLSGVQPEDEAEYYCVLWYSNRWVFGGGTKLTVL/GGGSGGGS/EVQLVESGGGLVQPGGSL
KLSCAASGFTFNKYAMNWVRQAPGKGLEWVARIRSKYDYKDDDDKADSVKDRFTISRDDSKNTAYLQMNNLKTEDTAVYY
CVRHGNFGNSYISYWAYWGQGTLVTVSS/GGGGSGGGS/EVQLVESGGGLVQPGNSLRLSCAASGFTFSKFGMSWVRQAP
GKGLEWVSSISGSGRDTLYAESVKGRFTISRDNAKTTLYLQMNSLRPEDTAVYYCTIGGSLSVSSQGTLVTVSS/HHHHHH
(SEQ ID NO:332)

Pro513 aCA9 hVIB476 sdAb – aCD3 Vh (2B2) – NCL-8 – aCD3Vl (2B2) – aCA9 hVIB476 sdAb

– NCL-16 - aCD3Vli – NCL-8 - aCD3Vhi – aHSA (10GE) - His6

QVQLVESGGGLVQPGGSLRLSCAASGNIFIINVMGWYRQAPGKQRELVATITNGGRTHYADSVKGRFTISRDNSKNTLYLQM
NSLRAEDTAVYYCNANHIELGDYWGQGTLVTVSS/GGSGGGS/EVQLVESGGGLVQPGGSLKLSCAASGFTFNKYAINWVR
QAPGKGLEWVARIRSKYNNYATYYADQVKDRFTISRDDSKNTAYLQMNNLKTEDTAVYYCVRHANFGNSYISYWAYWGQ
GTLVTVSS/GGGSGGGS/QTVVTQEPSLTVSPGGTVTLTCASSTGAVTSGNYPNWVQQKPGQAPRGLIGGTKFLVPGTPARF
SGSLLGGKAALTLSGVQPEDEAEYYCTLWYSNRWVFGGGTKLTVL/GGGSGGGS/QVQLVESGGGLVQPGGSLRLSCAASGN
IFIINVMGWYRQAPGKQRELVATITNGGRTHYADSVKGRFTISRDNSKNTLYLQMNSLRAEDTAVYYCNANHIELGDYWGQ
GTLVTVSS/GGGSGGGSGGGSGGGS/QTVVTQEPSLTVSPGGTVTLTCGSSTGAVTSGNYPNWVQQKPGQAPRGLIGDYKD
DDDKGTPARFSGSLLGGKAALTLSGVQPEDEAEYYCVLWYSNRWVFGGGTKLTVL/GGGSGGGS/EVQLVESGGGLVQPGG
SLKLSCAASGFTFNKYAMNWVRQAPGKGLEWVARIRSKYDYKDDDDKADSVKDRFTISRDDSKNTAYLQMNNLKTEDTAV
YYCVRHGNFGNSYISYWAYWGQGTLVTVSS/GGGSGGGS/EVQLVESGGGLVQPGNSLRLSCAASGFTFSKFGMSWVRQ
APGKGLEWVSSISGSGRDTLYAESVKGRFTISRDNAKTTLYLQMNSLRPEDTAVYYCTIGGSLSVSSQGTLVTVSS/HHHHHH
(SEQ ID NO:333)

Figure 63CC

Pro186 aEGFR sdAb – aCD3 Vh (2B2) – NCL-8 – aCD3Vl (2B2) - aEGFR sdAb

– MMP9-15 - aCD3Vll –NCL-8 - aCD3Vhi – aHSA (10GE) - His6

QVKLEESGGGSVQTGGSLRLTCAAS<u>GRTSRSYGMG</u>WFRQAPGKEREFVS<u>GISWRGDSTGYADSVKG</u>RFTISRDNAKNTVDL
QMNSLKPEDTAIYYCAA<u>AAGSAWYGTLYEYDY</u>WGQGTQVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVP</u>GTPARFSGSLLGGKAALTLSGVQPEDEAEYYC<u>TLWYSNRWV</u>FGGGTKLTVL/<u>GGGSGGGS</u>/QVKLEESGGGSVQTGGSL
RLTCAAS<u>GRTSRSYGMG</u>WFRQAPGKEREFVS<u>GISWRGDSTGYADSVKG</u>RFTISRDNAKNTVDLQMNSLKPEDTAIYYCAA<u>A</u>
<u>AGSAWYGTLYEYDY</u>WGQGTQVTVSS/<u>SGGPGPAGMKGLPGS</u>/QTVVTQEPSLTVSPGGTVTLTC<u>GSSTGAVTSGNYPN</u>WV
QQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGGS</u>
/EVQLVESGGGLVQPGGSLKLSCAAS<u>GFTFNKYAMN</u>WVRQAPGKGLEWVA<u>RIRSKYDYKDDDDKADSVKD</u>RFTISRDDSKN
TAYLQMNNLKTEDTAVYYCVR<u>HGNFGNSYISYWAY</u>WGQGTLVTVSS/<u>GGGGSGGGS</u>/EVQLVESGGGLVQPGNSLRLSCAA
S<u>GFTFSKFGMS</u>WVRQAPGKGLEWVS<u>SISGSGRDTLYAESVKG</u>RFTISRDNAKTTLYLQMNSLRPEDTAVYYCT<u>GGSLSVSSQ</u>
GTLVTVSS/HHHHHH (SEQ ID NO:334)

Pro214 aEGFR sdAb – aCD3 Vh (2B2) – NCL-8 – aCD3Vl (2B2) - aEGFR sdAb

– NCL-15 - aCD3Vll – NCL-8 - aCD3Vhi – aHSA (10GE) - His6

QVKLEESGGGSVQTGGSLRLTCAAS<u>GRTSRSYGMG</u>WFRQAPGKEREFVS<u>GISWRGDSTGYADSVKG</u>RFTISRDNAKNTVDL
QMNSLKPEDTAIYYCAA<u>AAGSAWYGTLYEYDY</u>WGQGTQVTVSS/<u>GGGSGGGS</u>/EVQLVESGGGLVQPGGSLKLSCAAS<u>GFT</u>
<u>FNKYAIN</u>WVRQAPGKGLEWVA<u>RIRSKYNNYATYYADQVKD</u>RFTISRDDSKNTAYLQMNNLKTEDTAVYYCVR<u>HANFGNSYI</u>
<u>SYWAY</u>WGQGTLVTVSS/<u>GGGSGGGS</u>/QTVVTQEPSLTVSPGGTVTLTC<u>ASSTGAVTSGNYPN</u>WVQQKPGQAPRGLIG<u>GTK</u>
<u>FLVP</u>GTPARFSGSLLGGKAALTLSGVQPEDEAEYYC<u>TLWYSNRWV</u>FGGGTKLTVL/<u>GGGSGGGS</u>/QVKLEESGGGSVQTGGSL
RLTCAAS<u>GRTSRSYGMG</u>WFRQAPGKEREFVS<u>GISWRGDSTGYADSVKG</u>RFTISRDNAKNTVDLQMNSLKPEDTAIYYCAA<u>A</u>
<u>AGSAWYGTLYEYDY</u>WGQGTQVTVSS/<u>GGGGSGGGGSGGGGS</u>/QTVVTQEPSLTVSPGGTVTLTC<u>GSSTGAVTSGNYPN</u>W
VQQKPGQAPRGLIG<u>DYKDDDDK</u>GTPARFSGSLLGGKAALTLSGVQPEDEAEYYC<u>VLWYSNRWV</u>FGGGTKLTVL/<u>GGGSGGG</u>
<u>S</u>/EVQLVESGGGLVQPGGSLKLSCAAS<u>GFTFNKYAMN</u>WVRQAPGKGLEWVA<u>RIRSKYDYKDDDDKADSVKD</u>RFTISRDDSK
NTAYLQMNNLKTEDTAVYYCVR<u>HGNFGNSYISYWAY</u>WGQGTLVTVSS/<u>GGGGSGGGS</u>/EVQLVESGGGLVQPGNSLRLSCA
AS<u>GFTFSKFGMS</u>WVRQAPGKGLEWVS<u>SISGSGRDTLYAESVKG</u>RFTISRDNAKTTLYLQMNSLRPEDTAVYYCT<u>GGSLSVSS</u>
QGTLVTVSS/HHHHHH (SEQ ID NO335:)

Figure 63DD

Pro225 a87H3 hF7 sdAb – aCD3 Vh (2B2) – NCL-8 – aCD3Vl (2B2) - a87H3 hF7 sdAb

– MMP9-15 - aCD3Vli –NCL-8 - aCD3Vhi – aHSA (10GE) - His6

QVQLQESGGGLVQPGGSLRLSCAPSRRTFHTYHMGWFRQAPGKEREFVAVINWSGGSTVYADSVKGRFTISRDNSKNTLYL
QMNSLRAEDTAVYYCAAGGATTQRATEASYDYWGQGTLVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVQLQESGGGLVQPGGS
LRLSCAPSRRTFHTYHMGWFRQAPGKEREFVAVINWSGGSTVYADSVKGRFTISRDNSKNTLYLQMNSLRAEDTAVYYCAA
GGATTQRATEASYDYWGQGTLVTVSS/SGGPGPAGMKGLPGS/QTVVTQEPSLTVSPGGTVTLTCGSSTGAVTSGNYPNW
VQQKPGQAPRGLIGDYKDDDDKGTPARFSGSLLGGKAALTLSGVQPEDEAEYYCVLWYSNRWVFGGGTKLTVL/GGGSGGG
S/EVQLVESGGGLVQPGGSLKLSCAASGFTFNKYAMNWVRQAPGKGLEWVARIRSKYDYKDDDDKADSVKDRFTISRDDSK
NTAYLQMNNLKTEDTAVYYCVRHGNFGNSYISYWAYWGQGTLVTVSS/GGGGSGGGS/EVQLVESGGGLVQPGNSLRLSCA
ASGFTFSKFGMSWVRQAPGKGLEWVSSISGSGRDTLYAESVKGRFTISRDNAKTTLYLQMNSLRPEDTAVYYCTGGSLSVSS
QGTLVTVSS/HHHHHH (SEQ ID NO:336)

Pro295 a87H3 hF7 sdAb – aCD3 Vh (2B2) – NCL-8 – aCD3Vl (2B2) - a87H3 hF7 sdAb

– NCL-15 - aCD3Vli – NCL-8 - aCD3Vhi – aHSA (10GE) - His6

QVQLQESGGGLVQPGGSLRLSCAPSRRTFHTYHMGWFRQAPGKEREFVAVINWSGGSTVYADSVKGRFTISRDNSKNTLYL
QMNSLRAEDTAVYYCAAGGATTQRATEASYDYWGQGTLVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVQLQESGGGLVQPGGS
LRLSCAPSRRTFHTYHMGWFRQAPGKEREFVAVINWSGGSTVYADSVKGRFTISRDNSKNTLYLQMNSLRAEDTAVYYCAA
GGATTQRATEASYDYWGQGTLVTVSS/GGGSGGGGSGGGS/QTVVTQEPSLTVSPGGTVTLTCGSSTGAVTSGNYPNW
VQQKPGQAPRGLIGDYKDDDDKGTPARFSGSLLGGKAALTLSGVQPEDEAEYYCVLWYSNRWVFGGGTKLTVL/GGGSGGG
S/EVQLVESGGGLVQPGGSLKLSCAASGFTFNKYAMNWVRQAPGKGLEWVARIRSKYDYKDDDDKADSVKDRFTISRDDSK
NTAYLQMNNLKTEDTAVYYCVRHGNFGNSYISYWAYWGQGTLVTVSS/GGGGSGGGS/EVQLVESGGGLVQPGNSLRLSCA
ASGFTFSKFGMSWVRQAPGKGLEWVSSISGSGRDTLYAESVKGRFTISRDNAKTTLYLQMNSLRPEDTAVYYCTGGSLSVSS
QGTLVTVSS/HHHHHH (SEQ ID NO:337)

Figure 63EE

Pro 817 aEGFR sdAb – aCD3 Vh (2B2) – NCL-8 – aCD3Vl (2B2) – aEGFR sdAb

– MMP9-15 – aCD3Vll –NCL-8 – aCD3Vhi – HSA

QVKLEESGGGSVQTGGSLRLTCAASGRTSRSYGMGWFRQAPGKEREFVSGISWRGDSTGYADSVKGRFTISRDNAKNTVDL
QMNSLKPEDTAIYYCAAAAGSAWYGTLYEYDYWGQGTQVTVSS/GGGSGGGS/EVQLVESGGGLVQPGGSLKLSCAASGFT
FNKYAINWVRQAPGKGLEWVARIRSKYNNYATYYADQVKDRFTISRDDSKNTAYLQMNNLKTEDTAVYYCVRHANFGNSYI
SYWAYWGQGTLVTVSS/GGGSGGGS/QTVVTQEPSLTVSPGGTVTLTCASSTGAVTSGNYPNWVQQKPGQAPRGLIGGTK
FLVPGTPARFSGSLLGGKAALTLSGVQPEDEAEYYCTLWYSNRWVFGGGTKLTVL/GGGSGGGS/QVKLEESGGGSVQTGGSL
RLTCAASGRTSRSYGMGWFRQAPGKEREFVSGISWRGDSTGYADSVKGRFTISRDNAKNTVDLQMNSLKPEDTAIYYCAAA
AGSAWYGTLYEYDYWGQGTQVTVSS/SGGPGPAGMKGLPGS/QTVVTQEPSLTVSPGGTVTLTCGSSTGAVTSGNYPNWV
QQKPGQAPRGLIGDYKDDDDKGTPARFSGSLLGGKAALTLSGVQPEDEAEYYCVLWYSNRWVFGGGTKLTVL/GGGSGGGS
/EVQLVESGGGLVQPGGSLKLSCAASGFTFNKYAMNWVRQAPGKGLEWVARIRSKYDYKDDDDKADSVKDRFTISRDDSKN
TAYLQMNNLKTEDTAVYYCVRHGNFGNSYISYWAYWGQGTLVTVSS/GGGGSGGGS/DAHKSEVAHRFKDLGEENFKALVL
IAFAQYLQQCPFEDHVKLVNEVTEFAKTCVADESAENCDKSLHTLFGDKLCTVATLRETYGEMADCCAKQEPERNECFLQHKD
DNPNLPRLVRPEVDVMCTAFHDNEETFLKKYLYEIARRHPYFYAPELLFFAKRYKAAFTECCQAADKAACLLPKLDELRDEGKAS
SAKQRLKCASLQKFGERAFKAWAVARLSQRFPKAEFAEVSKLVTDLTKVHTECCHGDLLECADDRADLAKYICENQDSISSKLKE
CCEKPLLEKSHCIAEVENDEMPADLPSLAADFVESKDVCKNYAEAKDVFLGMFLYEYARRHPDYSVVLLLRLAKTYKTTLEKCCA
AADPHECYAKVFDEFKPLVEEPQNLIKQNCELFEQLGEYKFQNALLVRYTKKVPQVSTPTLVEVSRNLGKVGSKCCKHPEAKRM
PCAEDYLSVVLNQLCVLHEKTPVSDRVTKCCTESLVNRRPCFSALEVDETYVPKEFNAETFTFHADICTLSEKERQIKKQTALVELV
KHKPKATKEQLKAVMDDFAAFVEKCCKADDKETCFAEEGKKLVAASRAALGL (SEQ ID NO:338)

Inactivated $V_H$ & $V_L$ domains pair
with αCD3 $V_H$ & $V_L$ domains

Predicted COBRA Folding

Analytical Size Exclusion
Chromatography

Pro186

Binds EGFR
Impaired CD3 binding
Binds serum albumin

Pro186 Cleavage Products

Binds EGFR
Impaired CD3 binding

Binds serum albumin

Pro186 Active Dimer

Binds EGFR
Binds CD3

| | sdAb | Pro186 | | | Active Dimer | |
|---|---|---|---|---|---|---|
| | αEGFR $K_D$ (nM) | αEGFR $K_D$ (nM) | αCD3 $K_D$ (nM) | αHSA $K_D$ (nM) | αEGFR $K_D$ (nM) | αCD3 $K_D$ (nM) |
| Human | 2.7 | 0.12 | nb | 11.3 | <0.01 | 1.7 |
| Cyno | 6.3 | 0.14 | nb | 10.8 | <0.01 | 2.4 |
| Mouse | nb* | nb | nb | 106.3 | nb | nb |

Pro186 (2µM) cleaved by activated MMP2 (2.2nM) and MMP9 (2nM); gel shown is overnight cleavage.

FIG. 69

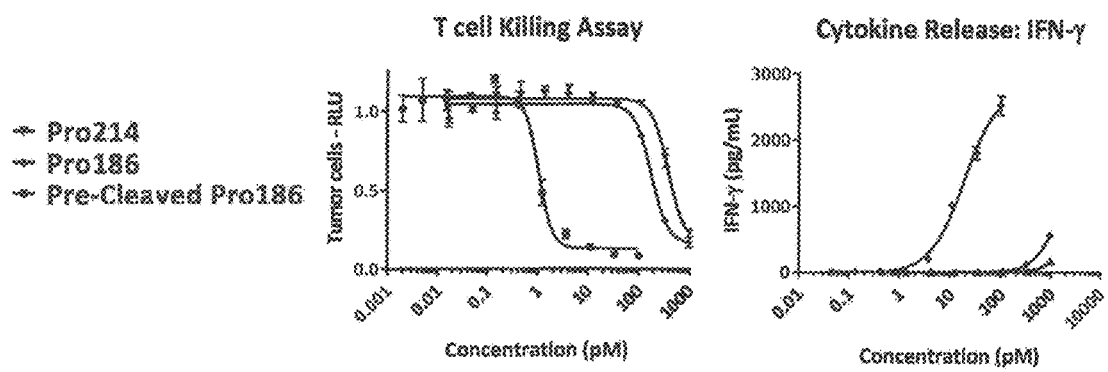

FIG. 70

| Characterization | Tumor cell lines | | |
|---|---|---|---|
| | LoVo (CRC) | HT29 (CRC) | SCC25 (H&N) |
| In vitro EGFR expression: Flow Cytometry[1] | 8,774 | 33,218 | 239,344 |
| In vivo EGFR expression: IHC[2] | ++ | ++ | ++++ |
| $EC_{50}$ T cell Killing Assay[3] (Pre-Cleaved MVC-101) | 0.2 pM | 0.4 pM | 0.1 pM |
| $EC_{50}$ IFNγ Release Assay[4] (Pre-Cleaved MVC-101) | 3.4 pM | 2.7 pM | 0.7 pM |

[1] Abs-bound/cell: measured using 1:1 PE labeled αEGFR mAb #EGFR.1 and BD QuantiBrite Beads
[2] IHC staining with αEGFR mAb #SP84 and MACH4-HRP detection (Ensigna)
[3] Luciferase expressing tumor cells co-cultured with human T cells at an E:T of 10:1 for 48 hours measured by Steady-Glo (Promega)
[4] IFNγ release measured using Meso Scale Discovery V-Plex at E:T 10:1 at 24 hours Abs bound/cell: measured using 1:1 PE labeled
αEGFR mAb #EGFR.1 and BD QuantiBrite Beads IHC staining with αEGFR mAb #SP84 and MACH4-
HRP detection (Ensigna)

- Implant tumors subcutaneous in right flank of NSG Mice
- Established tumor = ~200 mm³
- Activate and expand human T cells in culture (10 days)
- Day 0: randomize mice based on tumor size
- Day 0: implant 2.5x10⁶ human T cells IV
- Day 0: initiate IV administration (bolus injection)
- Dose q3dx7

Pro225 (αB7H3/MMP9 linker)

US 11,685,780 B2

SINGLE DOMAIN ANTIGEN BINDING DOMAINS THAT BIND HUMAN TROP2

CROSS-REFERENCING RELATED APPLICATIONS

This application claims priority to U.S. Provisional Application No. 62/814,210 filed Mar. 5, 2019, U.S. Provisional Application No. 62/814,744 filed Mar. 6, 2019, and U.S. Provisional Application No. 62/826,523 filed Mar. 29, 2019, the disclosures are herein incorporated by reference in their entireties.

BACKGROUND OF THE INVENTION

The selective destruction of an individual cell or a specific cell type is often desirable in a variety of clinical settings. For example, it is a primary goal of cancer therapy to specifically destroy tumor cells, while leaving healthy cells and tissues as intact and undamaged as possible. One such method is by inducing an immune response against the tumor, to make immune effector cells such as natural killer (NK) cells or cytotoxic T lymphocytes (CTLs) attack and destroy tumor cells.

The use of intact monoclonal antibodies (mAb), which provide superior binding specificity and affinity for a tumor-associated antigen, have been successfully applied in the area of cancer treatment and diagnosis. However, the large size of intact mAbs, their poor bio-distribution, low potency and long persistence in the blood pool have limited their clinical applications. For example, intact antibodies can exhibit specific accumulation within the tumor area. In biodistribution studies, an inhomogeneous antibody distribution with primary accumulation in the peripheral regions is noted when precisely investigating the tumor. Due to tumor necrosis, inhomogeneous antigen distribution and increased interstitial tissue pressure, it is not possible to reach central portions of the tumor with intact antibody constructs. In contrast, smaller antibody fragments show rapid tumor localization, penetrate deeper into the tumor, and also, are removed relatively rapidly from the bloodstream. However, many antibodies, including scFvs and other constructs, show "on target/off tumor" effects, wherein the molecule is active on non-tumor cells, causing side effects, some of which can be toxic. The present invention is related to novel constructs that are selectively activated in the presence of tumor proteases.

SUMMARY OF THE INVENTION

The present invention provides a number of different protein compositions for the treatment of cancer. Accordingly, in one aspect, the invention provides "Format 2" proteins comprising, from N- to C-terminal: a first single domain antigen binding domain (sdABD) that binds to a human tumor target antigen (TTA) (sdABD-TTA); b) a domain linker; c) a constrained Fv domain comprising: i) a variable heavy domain comprising a vhCDR1, vhCDR2 and vhCDR3; ii) a constrained non-cleavable linker (CNCL); and iii) a variable light domain comprising vlCDR1, vlCDR2 and vlCDR3; d) a second domain linker; e) a second sdABD-TTA; f) a cleavable linker (CL); g) a constrained pseudo Fv domain comprising: i) a pseudo light variable domain; ii) a non-cleavable linker (NCL); and iii) a pseudo heavy variable domain; h) a third domain linker; and i) a third sdABD that binds to human serum albumin; wherein the variable heavy domain and the variable light domain are capable of binding human CD3 but the constrained Fv domain does not bind CD3; the variable heavy domain and the pseudo variable light domain intramolecularly associate to form an inactive Fv; and the variable light domain and the pseudo variable heavy domain intramolecularly associate to form an inactive Fv. In some embodiments, the human tumor target antigen is B7H3.

In a further aspect, the invention provides proteins comprising, from N- to C-terminal: a first single domain antigen binding domain (sdABD) that binds to a human tumor target antigen (TTA) (sdABD-TTA) comprising sdFR1-sdCDR1-sdFR2-sdCDR2-sdFR3-sdCDR3-sdFR4; b) a first domain linker; c) a constrained Fv domain comprising: i) a variable heavy domain comprising vhFR1-vhCDR1-vhFR2-vhCDR2-vhFR3-vhCDR3-vhFR4; ii) a constrained non-cleavable linker (CNCL); and iii) a variable light domain comprising vlFR1-vlCDR1-vlFR2-vlCDR2-vlFR3-vlCDR3-vlFR4; d) a second domain linker; e) a second sdABD-TTA; f) a cleavable linker (CL); g) a constrained pseudo Fv domain comprising: i) a pseudo light variable domain comprising sdFR1-sdCDR1-sdFR2-sdCDR2-sdFR3-sdCDR3-sdFR4; ii) a non-cleavable linker (NCL); and iii) a pseudo heavy variable domain comprising vlFR1-vlCDR1-vlFR2-vlCDR2-vlFR3-vlCDR3-vlFR4; h) a third domain linker; and i) a third sdABD that binds to human serum albumin comprising sdFR1-sdCDR1-sdFR2-sdCDR2-sdFR3-sdCDR3-sdFR4; wherein the variable heavy domain and the variable light domain are capable of binding human CD3 but the constrained Fv domain does not bind CD3; the variable heavy domain and the pseudo variable light domain intramolecularly associate to form an inactive Fv; and the variable light domain and the pseudo variable heavy domain intramolecularly associate to form an inactive Fv. In some embodiments, the human tumor target antigen is B7H3.

In some embodiments of Format 2 proteins, the variable heavy domain is N-terminal to the variable light domain and the pseudo light variable domain is N-terminal to the pseudo variable heavy domain. In some embodiments, the variable heavy domain is N-terminal to the variable light domain and the pseudo variable light domain is C-terminal to the pseudo variable heavy domain. In some embodiments, the variable heavy domain is C-terminal to the variable light domain and the pseudo variable light domain is N-terminal to the pseudo variable heavy domain. In some embodiments, the variable heavy domain is C-terminal to the variable light domain and the pseudo variable light domain is C-terminal to the pseudo variable heavy domain.

In some embodiments of Format 2 proteins, the first sdABDTTA and the second sdABDTTA are the same. In some embodiments, the first sdABDTTA and the second sdABDTTA are different. In these embodiments, the sdABD-TTAs are selected from those depicted in FIG. 5, including SEQ ID NO:1, SEQ ID NO:5, SEQ ID NO:9, SEQ ID NO:13; SEQ ID NO:17; SEQ ID NO:21, SEQ ID NO:25, SEQ ID NO:29, SEQ ID NO:33, SEQ ID NO:37, SEQ ID NO:41, SEQ ID NO:45, SEQ ID NO:49, SEQ ID NO:53, SEQ ID NO:57, SEQ ID NO:61, SEQ ID NO:65, SEQ ID NO:69, SEQ ID NO:73, 77, SEQ ID NO:81, SEQ ID NO:85, SEQ ID NO:89, SEQ ID NO:93, SEQ ID NO:97, SEQ ID NO:101, SEQ ID NO:105, SEQ ID NO:109 and SEQ ID NO:113.

In some embodiments of Format 2 proteins, the pseudo heavy variable domain of the constrained pseudo Fv domain is selected from the group of SEQ ID NO:146 ($V_{Hi}$), SEQ ID NO:150 ($V_{Hi2}$) and SEQ ID NO:154 (VHiGL4), as shown in FIG. 5. In some embodiments, the pseudo light variable domain of the constrained pseudo Fv domain is selected from the group of SEQ ID NO:130 (V$_{Li}$), SEQ ID NO:134 (V$_{Li2}$) and SEQ ID NO:138 (V$_{LiGL}$), as shown in FIG. 5.

In a further aspect, the invention provides "Format 1" proteins comprising, from N- to C-terminal: a) a first sdABD-TTA; b) a first domain linker; c) a constrained Fv domain comprising: i) a first variable heavy domain comprising a vhCDR1, vhCDR2 and vhCDR3; ii) a constrained cleavable linker (CCL); and iii) a first variable light domain comprising vlCDR1, vlCDR2 and vlCDR3; d) a second domain linker; e) a second sdABD-TTA; f) a cleavable linker (CL); g) a constrained pseudo Fv domain comprising: i) a first pseudo light variable domain; ii) a non-cleavable linker (NCL); and iii) a first pseudo heavy variable domain; h) a third domain linker; and i) a third sdABD that binds to human serum albumin; wherein said first variable heavy domain and said first variable light domain are capable of binding human CD3 but said constrained Fv domain does not bind CD3; wherein said first variable heavy domain and said first pseudo variable light domain intramolecularly associate to form an inactive Fv; and wherein said first variable light domain and said first pseudo variable heavy domain intramolecularly associate to form an inactive Fv. In an additional aspect, the invention provides "Format 4" proteins comprising, from N- to C-terminal: a) a single domain antigen binding domain (sdABD) that binds to a human tumor target antigen (TTA) (sdABD-TTA); b) a first domain linker; c) a constrained Fv domain comprising: i) a first variable heavy domain comprising a vhCDR1, vhCDR2 and vhCDR3; ii) a constrained non-cleavable linker (CNCL); and iii) a first variable light domain comprising vlCDR1, vlCDR2 and vlCDR3; d) a cleavable linker (CL); e) a second sdABD that binds to human serum albumin; f) a domain linker; g) a constrained pseudo Fv domain comprising: i) a first pseudo light variable domain; ii) a non-cleavable linker (NCL); and iii) a first pseudo heavy variable domain; wherein said first variable heavy domain and said first variable light domain are capable of binding human CD3 but said constrained Fv domain does not bind CD3; wherein said first variable heavy domain and said first pseudo variable light domain intramolecularly associate to form an inactive Fv; and wherein said first variable light domain and said first pseudo variable heavy domain intramolecularly associate to form an inactive Fv.

In a further aspect to the Format 1, Format 2 and Format 4 proteins listed above, said first variable heavy domain is N-terminal to said first variable light domain and said pseudo light variable domain is N-terminal to said pseudo variable heavy domain.

In a further aspect to the Format 1, Format 2 and Format 4 proteins listed above, said first variable heavy domain is N-terminal to said first variable light domain and said pseudo variable heavy domain is N-terminal to said pseudo variable light domain.

In a further aspect to the Format 1, Format 2 and Format 4 proteins listed above, said first variable light domain is N-terminal to said first variable heavy domain and said pseudo light variable domain is N-terminal to said pseudo variable heavy domain.

In a further aspect to the Format 1, Format 2 and Format 4 proteins listed above, said first variable light domain is N-terminal to said first variable heavy domain and said pseudo variable heavy domain is N-terminal to said pseudo variable light domain.

In an additional aspect, the invention provides Format 1 and 2 proteins wherein said first and second TTA are the same.

In a further aspect, the invention provides Format 1 and 2 proteins wherein said first and second TTA are different.

In an additional aspect, the invention provides Format 1, 2 and 4 proteins wherein said first and second TTA are selected from EGFR, EpCAM, FOLR1, Trop2, ca9 and B7H3. These sequences can be selected from the group consisting of SEQ ID NO:1, SEQ ID NO:5, SEQ ID NO:9, SEQ ID NO:13; SEQ ID NO:17; SEQ ID NO:21, SEQ ID NO:25, SEQ ID NO:29, SEQ ID NO:33, SEQ ID NO:37, SEQ ID NO:41, SEQ ID NO:45, SEQ ID NO:49, SEQ ID NO:53, SEQ ID NO:57, SEQ ID NO:61, SEQ ID NO:65, SEQ ID NO:69, SEQ ID NO:73, 77, SEQ ID NO:81, SEQ ID NO:85, SEQ ID NO:89, SEQ ID NO:93, SEQ ID NO:97, SEQ ID NO:101, SEQ ID NO:105, SEQ ID NO:109 and SEQ ID NO:113.

In a further aspect, the invention provides Format 1, 2 and 4 proteins wherein said half-life extension domain has SEQ ID NO:117 (aHSA (10GE)) and SEQ ID NO:121 (aHSA with His tag).

In an additional aspect, the invention provides Format 1, 2 and 4 proteins wherein said cleavable linker is cleaved by a human protease selected from the group consisting of MMP2, MMP9, Meprin A, Meprin B, Cathepsin S, Cathepsin K, Cathespin L, GranzymeB, uPA, Kallekriein7, matriptase and thrombin, or others as depicted in FIG. 6.

In a further aspect, the invention provides a protein selected from the group consisting of Pro186, Pro225, Pro226, Pro233, Pro262, Pro311, Pro312, Pro313, Pro356, Pro359, Pro364, Pro388, Pro448, Pro449, Pro450, Pro451, Pro495, Pro246, Pro254, Pro255, Pro256, Pro420, Pro421, Pro432, Pro479, Pro480, Pro187, Pro221, Pro222, Pro223, Pro224, Pro393, Pro394, Pro395, Pro396, Pro429, Pro430, Pro431, Pro601, Pro602, V3 and V4, Pro664, Pro665, Pro667, Pro694, Pro695, Pro565, Pro566, Pro567, Pro727, Pro728, Pro729, Pro730, Pro731, Pro676, Pro677, Pro678, Pro679, Pro808, Pro819, Pro621, Pro622, Pro640, Pro641, Pro642, Pro643, Pro744, Pro746, Pro638, Pro639, Pro396, Pro476, Pro706, Pro709, Pro470, Pro471, Pro551, Pro552, Pro623, Pro624, Pro698, Pro655, Pro656, Pro657, Pro658, Pro516, Pro517, Pro518 and Pro519.

In an additional aspect, the invention provides nucleic acids encoding a Format 1, Format 2 or Format 4 protein as described herein, as well as expression vectors and host cells comprising the nucleic acids encoding the protein.

In a further aspect, the invention provides methods of making the proteins of the invention and methods of treating patients in need thereof.

In an additional aspect, the invention provides compositions comprising "Format 3A" pairs of pro-drug proteins, comprising: a) a first protein comprising, from N- to C-terminal: i) a first sdABD-TTA; ii) a first domain linker; iii) a pseudo Fv domain comprising, from N- to C-terminal: 1) a variable heavy chain comprising a vhCDR1, vhCDR2 and vhCDR3; 2) a cleavable linker; and 3) a first pseudo variable light domain comprising iVLCDR1, iVLCDR2 and iVLCDR3; iv) a second domain linker; v) a sdABD-HSA; a) a second protein comprising, from N- to C-terminal: i) a third sdABD that binds to a human tumor target antigen; ii) a third domain linker; iii) a pseudo Fv domain comprising, from N- to C-terminal: 1) a variable light chain comprising a VLCDR1, VLCDR2 and VLCDR3; 2) a cleavable linker; and 3) a first pseudo variable heavy domain comprising iVHCDR1, iVHCDR2 and iVHCDR3; iv) a fourth domain linker; v) a sdABD-HSA; wherein said first variable heavy domain and said first variable light domain are capable of binding human CD3 when associated; wherein said first variable heavy domain and said first pseudo variable light domain intermolecularly associate to form an inactive Fv; wherein said first variable light domain and said first pseudo variable heavy domain intermolecularly associate to form an inactive Fv; and wherein said first and third sdABD are selected from the group consisting of SEQ ID NO:1, SEQ ID NO:5, SEQ ID NO:9, SEQ ID NO:13; SEQ ID NO:17; SEQ ID NO:21, SEQ ID NO:25, SEQ ID NO:29, SEQ ID NO:33, SEQ ID NO:37, SEQ ID NO:41, SEQ ID NO:45, SEQ ID NO:49, SEQ ID NO:53, SEQ ID NO:57, SEQ ID NO:61, SEQ ID NO:65, SEQ ID NO:69, SEQ ID NO:73, 77, SEQ ID NO:81, SEQ ID NO:85, SEQ ID NO:89, SEQ ID NO:93, SEQ ID NO:97, SEQ ID NO:101, SEQ ID NO:105, SEQ ID NO:109 and SEQ ID NO:113.

In a further aspect, the invention provides compositions comprising "Format 3B" pairs of pro-drug proteins, comprising a) a first protein comprising, from N- to C-terminal: i) a first sdABD-TTA; ii) a first domain linker; iii) a second sdABD-TTA; iv) a second domain linker; iii) a pseudo Fv domain comprising, from N- to C-terminal: 1) a variable heavy chain comprising a vhCDR1, vhCDR2 and vhCDR3; 2) a cleavable linker; and 3) a first pseudo variable light domain comprising iVLCDR1, iVLCDR2 and iVLCDR3; iv) a third domain linker; and v) a sdABD-HSA; a) a first second protein comprising, from N- to C-terminal: i) a third sdABD-TTA; ii) a fourth domain linker; iii) a fourth sdABD-TTA; iv) a fifth domain linker; iii) a pseudo Fv domain comprising, from N- to C-terminal: 1) a variable light chain comprising a VLCDR1, VLCDR2 and VLCDR3; 2) a cleavable linker; and 3) a first pseudo variable heavy domain comprising iVHCDR1, iVHCDR2 and iVHCDR3; iv) a sixth domain linker; v) a sdABD-HSA; wherein said first variable heavy domain and said first variable light domain are capable of binding human CD3 when associated; wherein said first variable heavy domain and said first pseudo variable light domain intermolecularly associate to form an inactive Fv; and wherein said first variable light domain and said first pseudo variable heavy domain intermolecularly associate to form an inactive Fv.

In an additional aspect, Format 3A and Format 3B proteins have sdABD-HSA that have SEQ ID NO:117 or SEQ ID NO:121.

In a further aspect, Format 3A and Format 3B proteins have sdABD-TTA that binds to a TTA selected from EGFR, EpCAM, Trop2, CA9, FOLR1 and B7H3. The sdABD-TTAs can be selected from the group consisting of SEQ ID NO:1, SEQ ID NO:5, SEQ ID NO:9, SEQ ID NO:13; SEQ ID NO:17; SEQ ID NO:21, SEQ ID NO:25, SEQ ID NO:29, SEQ ID NO:33, SEQ ID NO:37, SEQ ID NO:41, SEQ ID NO:45, SEQ ID NO:49, SEQ ID NO:53, SEQ ID NO:57, SEQ ID NO:61, SEQ ID NO:65, SEQ ID NO:69, SEQ ID NO:73, 77, SEQ ID NO:81, SEQ ID NO:85, SEQ ID NO:89, SEQ ID NO:93, SEQ ID NO:97, SEQ ID NO:101, SEQ ID NO:105, SEQ ID NO:109 and SEQ ID NO:113.

In an additional aspect, the invention provides sdABDs that bind to human Trop2, having a sequence selected from SEQ ID NO:77, SEQ ID NO:81, SEQ ID NO:85, SEQ ID NO:89 and SEQ ID NO:93.

In a further aspect, the invention provides sdABDs that bind to human B7H3 having a sequence selected from SEQ ID NO:41, SEQ ID NO:45, SEQ ID NO:49, SEQ ID NO:53 and SEQ ID NO:57.

In an additional aspect, the invention provides sdABDs that bind to human CA9 having a sequence selected from SEQ ID NO:101, SEQ ID NO:105, SEQ ID NO:109 and SEQ ID NO:113.

In a further aspect the invention provides sdABDs that bind to human EpCAM having a sequence selected from SEQ ID NO:69 and SEQ ID NO:73.

In a further aspect, the invention provides nucleic acid compositions comprising first nucleic acids that encode the first protein members of the prodrug pair and second nucleic acids that encode the second protein members of the pairs, and expression vectors and host cells containing the nucleic acids.

BRIEF DESCRIPTION OF THE DRAWINGS

FIG. 1 also shows an anti-human serum albumin (HSA) domain as a half-life extension domain, in many embodiments an sdABD as defined herein, although as discussed herein, this is optional and/or can be replaced by other half-life extension domains; additionally, the half-life extension domain can also be N-terminal to the construct or internal as well. FIG. 1 also has the VH and VL of the Fv and iVH and iVL of the pseudo Fv in a specific order, e.g. from N- to C-terminal, VH-linker-VL (and iVL-linker-iVH) although as will be appreciated by those in the art, these can be reversed (VL-linker-VH and iVH-linker-iVL). Alternatively, one of these Fvs can be in one orientation and the other in the other orientation, although the expression of protein in the orientation as shown here was surprisingly higher than the other orientations.

FIG. 2 also shows an anti-human serum albumin (HSA) domain as a half-life extension domain, in many embodiments an sdABD as defined herein, although as discussed herein, this is optional and/or can be replaced by other half-life extension domains; additionally, the half-life extension domain can also be N-terminal to the construct or internal as well. FIG. 2 also has the VH and VL of the Fv and iVH and iVL of the pseudo Fv in a specific order, e.g. from N- to C-terminal, VH-linker-VL (and iVL-linker-iVH) although as will be appreciated by those in the art, these can be reversed (VL-linker-VH and iVH-linker-iVL). Alternatively, one of these Fvs can be in one orientation and the other in the other orientation, although the expression of protein in the orientation as shown here was surprisingly higher than the other orientations.

FIG. 3A-FIG. 3B depict "format 3" type of constructs, also sometimes referred to as "hemi-constructs" or "hemi-COBRA™" as outlined herein, as these are two different polypeptide chains that together make up an MCE therapeutic as is further discussed herein. In this embodiment, the constructs are delivered in pairs, with the pre-cleavage intramolecular self-assembly resulting in inactive anti-CD3 Fv domains. Upon cleavage, the inert variable domains are released, and the two active variable domains then intermolecularly assemble, to form an active anti-CD3 binding domain. The two sdABD-TTAs bind to the corresponding receptor on the tumor cell surface, and the cleavage is done by a protease. This allows the intermolecular assembly, since the molecules are physically held in place, favoring the assembly of the active anti-CD3 domain. As above for formats 1 and 2, in this embodiment, the N- to C-terminal order of the variable domains can be reversed, or mixed as well. Furthermore, the sdABD(HSA) can be either at the N- or C-terminus of each hemi-construct. Pro16 has the sdABD (HSA) at the C terminus and Pro17 has it at the N-terminus (see Pro19, SEQ ID NO:XX, has the sdABD(HSA) at the C-terminus). FIG. 3A shows Format 3 constructs with a single sdABD-TTA domain per hemi-construct, and FIG. 3B shows Format 3 constructs with two sdABD-TTAs per hemi-construct, in a "dual targeting" or "hetero-targeting" format. Note that FIG. 3B uses FOLR1 and EGFR as the two TTAs, but other combinations as outlined herein can also be used.

FIG. 4 depicts "format 4" type of constructs that are similar to "format 2" constructs but have only a single sdABD-TTA. The figure shows the sdABD-TTA to EGFR, but as will be appreciated by those in the art, other TTA can be used as well. Upon cleavage, the prodrug construct splits into two components, a half-life extension domain (in this case, sdABDs to HSA) linked to a pseudo Fv and an active moiety, that in the presence of a second active moiety from a different cleaved molecule, self-assembles into a dimeric active moiety that contains two anti-TTA domains. It should be noted that in "format 4" embodiments, the resulting active component is quadrivalent: there is bivalent binding to CD3 and bivalent binding to the TTA, rendering a bispecific binding protein. FIG. 4 also shows an anti-human serum albumin (HSA) domain as a half-life extension domain, in many embodiments an sdABD(½) as defined herein, although as discussed herein, this is optional and/or can be replaced by other half-life extension domains; additionally, the half-life extension domain can also be N-terminal to the construct or internal as well. FIG. 4 also has the VH and VL of the Fv and iVH and iVL of the pseudo Fv in a specific order, e.g. from N- to C-terminal, VH-linker-VL (and iVL-linker-iVH) although as will be appreciated by those in the art, these can be reversed (VL-linker-VH and iVH-linker-iVL). Alternatively, one of these Fvs can be in one orientation and the other in the other orientation, although the expression of protein in the orientation as shown here was surprisingly higher than the other orientations.

FIG. 5A-FIG. 5J depict a number of sequences of the invention. For antigen binding domains, the CDRs are underlined. As is more fully outlined herein, these domains can be assembled in a wide variety of configurations in the present invention, including "format 1", "format 2", "format 3" and "format 4" orientations.

FIG. 6A-FIG. 6D depict a number of suitable protease cleavage sites. As will be appreciated by those in the art, these cleavage sites can be used as cleavable linkers. In some embodiments, for example when more flexible cleavable linkers are required, there can be additional amino acids (generally glycines and serines) that are either or both N- and C-terminal to these cleavage sites.

FIG. 8A and FIG. 8B show that the constructs in isolation, but cleaved with different concentrations of protease, do not affect target cell viability. However, FIG. 8C shows that in combination, in the presence of protease, target cell viability is significantly diminished. FIG. 8D shows the general mechanism.

FIG. 12A shows that addition of pre-cleaved hemi-COBRA pairs results in efficacy on OvCAR8 cells, FIG. 12B shows that addition of pre-cleaved hemi-COBRA pairs results in efficacy on HCT116 cells, and FIG. 12C shows that addition of pre-cleaved hemi-COBRA pairs results in efficacy on LoVo cells, all of which are cancer cell lines.

FIG. 41 depicts the fact that different sdABD clones directed to human FOLR1 show differential killing. A Pro22 type construct (Pro51 with a FLAG sequence instead of a NCL) that binds to human FOLR1 was compared to a Pro22-EGFR construct against a number of cell line families.

FIG. 50 shows the humanization of sdABDs to human EpCAM.

FIG. 57A shows the parental Raji line, that doesn't express either receptor. FIG. 57B shows conditionality on the EpCAM line.

FIG. 57C shows conditionality on the EGRF line. FIG. 57D shows conditionality on the EpCAM/EGFR line.

FIG. 60A-FIG. 60C. FIG. 60A shows the cleavage of the MMP9 substrate by other MMPs. FIGS. 60B and 60C show cleavage of a FRET probe containing the MMP9 linker sequence.

FIG. 61A-FIG. 61B shows some of the exemplary constructs and their formats.

FIG. 62A-FIG. 62V shows a number of sequences of the invention, although many additional sequences are also found in the sequence listing. CDRs are underlined and bolded, linkers are double underlined (with cleavable linkers being italicized and double underlined) and domain separations are indicated by "/". All His6 tags are optional, as they can be used to reduce immunogenicity in humans as well as be purification tags.

FIGS. 63A to 63EE depict amino acid sequences of exemplary Format 2 constructs comprising a number of sdABD-B7H3 and a pseudo Fv domain (e.g., Vli2/Vhi2 domains). FIG. 63A depicts the amino acid sequences of Pro601 and Pro602. FIG. 63B depicts the amino acid sequences of V3 and V4. Pro601 includes two identical sdAbs that bind B7H3 (e.g., aB7H3 hF7 sdAbs). Pro602 includes two identical sdAbs that bind B7H3 (e.g., anti-B7H3 hF12 sdAbs). V3 includes two different sdAbs that bind B7H3 (e.g., an anti-B7H3 hF7 sdAb and an anti-B7H3 hF12 sdAb). V4 includes two different sdAbs that bind B7H3 (e.g., an anti-B7H3 hF7 sdAb and an anti-B4H3 hF12 sdAb).

FIG. 64A depicts a schematic of the Pro186 COBRA (SEQ ID NO:145 of FIG. 62B). FIG. 64B shows the predicted COBRA folding. FIG. 64C shows an analytical size exclusion chromatogram of Pro186.

FIG. 67A shows binding activity to human, cyno, and mouse articles. FIG. 67B shows PRO186 binding to human CD3epsilon; active PRO186 binding of human CD3epsilon, and active PRO186 binding of human EGFR.

FIG. 68A depicts a western blot of the active binding product molecules upon cleavage. FIG. 68B shows accumulation of the active binding product molecules relative to the cleavage time.

FIG. 69 shows in vitro activity of the conditional PRO186 construct. FIG. 69—left panel shows results of a T cell killing assay. FIG. 69—right panel shows the level of IFN-gamma release in relations to the concentration of the test articles.

FIG. 70 shows EGFR expression relative to activity in three tumor cell lines—LoVo (a colorectal cancer (CRC) cell line), HT-29 (a colorectal cancer (CRC) cell line), and SCC25 (a head and neck cancer cell line).

FIG. 71A shows EGFR cell surface density on the three cancer cell lines—LoVo, HT-29, and SCC25. FIG. 71B shows immunohistochemistry staining of EGFR, MMP2, and MMP9 of tumor xenografts.

FIG. 73—left panel shows regression of LoVo-derived tumors. FIG. 73—middle panel shows regression of HT-29-derived tumors. FIG. 73—right panel shows regression of SCC25-derived tumors.

FIG. 74A shows pharmacokinetics of the test articles in plasma of non-tumor bearing mice. FIG. 74B shows tumor volume of LoVo-derived tumors in mice administered the test articles.

Figure 120:
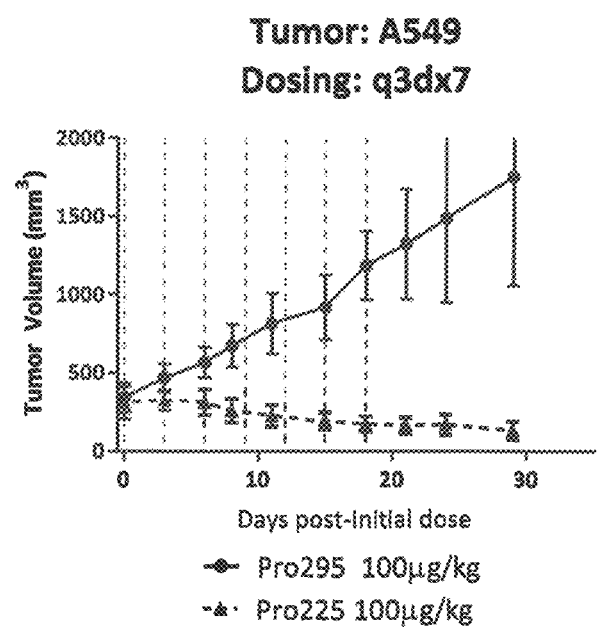

FIG. 120 depicts the results of a tumor regression study using Pro225, a construct with B7H3 targeting and an MMP9 linker. The study was done using a human PBMC engraftment model, wherein NSG-β2M–/– mice (Jackson) were engrafted i.v. with human PBMC; 3d post engraftment, mice were implanted with tumor cell lines subcutaneously. Once tumor growth was established, mice were randomized based on tumor volume, and test articles were dosed i.v. as indicated. Tumor volume was assessed by caliper measurement. The results show that Pro225 regresses established solid tumors compared to Pro295, the noncleavable control.

Figure 121:
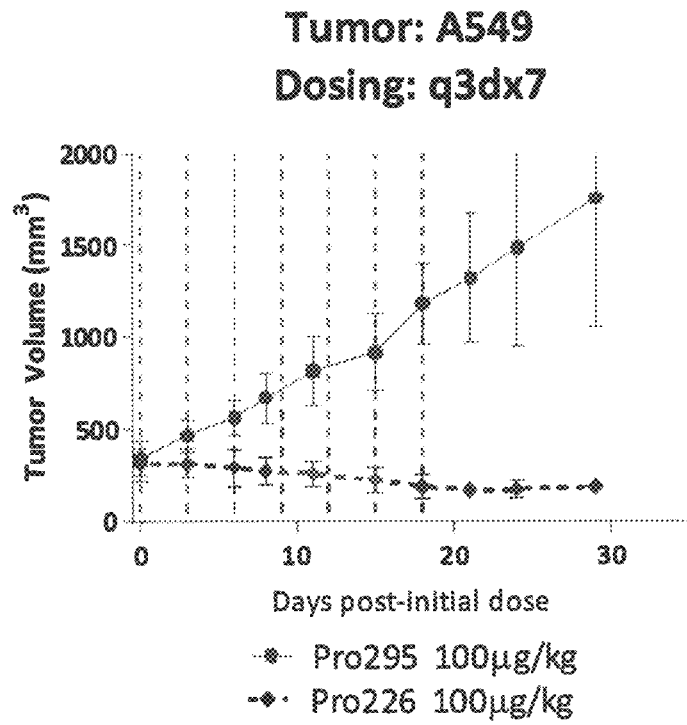

FIG. 121 depicts the results of a tumor regression study using Pro226, a construct with B7H3 targeting and an MMP9 linker. The study was done as described in FIG. 120, and the results show that Pro226 regresses established solid tumors compared to Pro295, the nocleavable control.

Figure 122:
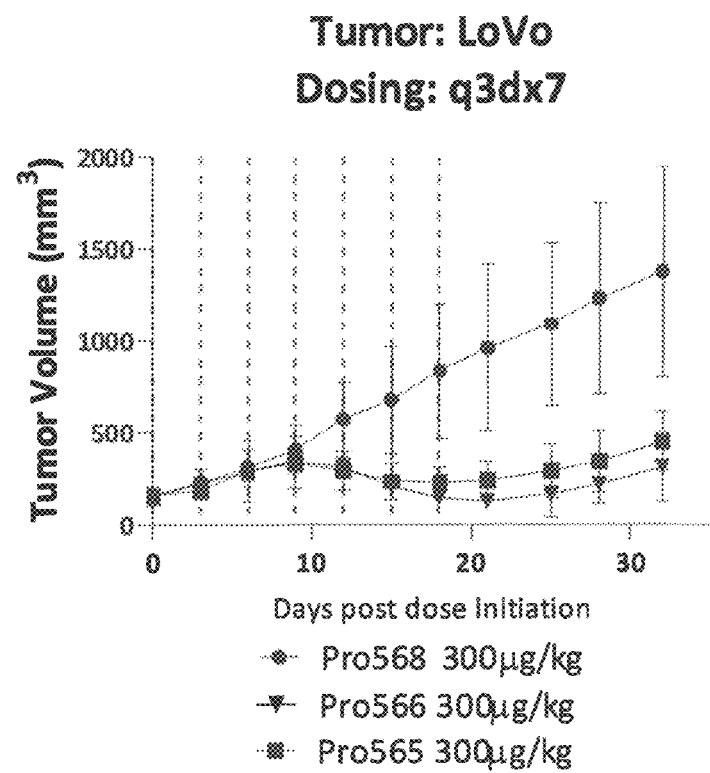

FIG. 122 depicts the results of a tumor regression study using Pro565 and Pro566, which both have EpCAM targeting and MMP9 linkers. The results show that both Pro565 and Pro566 demonstrate an anti-tumor response compared to Pro568, the non-cleavable control.

Figure 123:
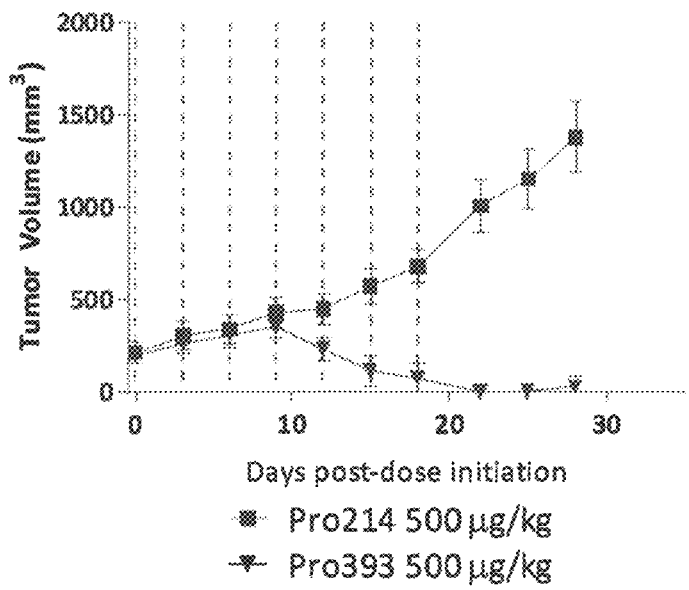

FIG. 123 depicts the results of a tumor regression study using Pro393 which utilizes EGFR targeting and an S9 linker, using the protocol described in FIG. 122. The results show that Pro393 regresses established solid tumors compared to Pro214 the non-cleavable control.

Figure 124:
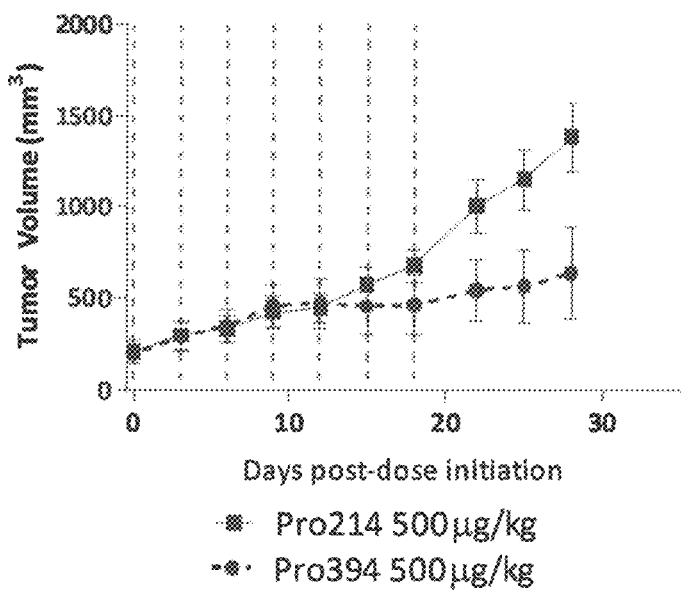

FIG. 124 depicts the results of a tumor regression study using Pro394 which utilizes EGFR targeting and an ST14 MV linker, using the protocol described in FIG. 122. The results show that Pro394 demonstrates a small anti-tumor response compared to Pro214 the non-cleavable control.

Figure 125:
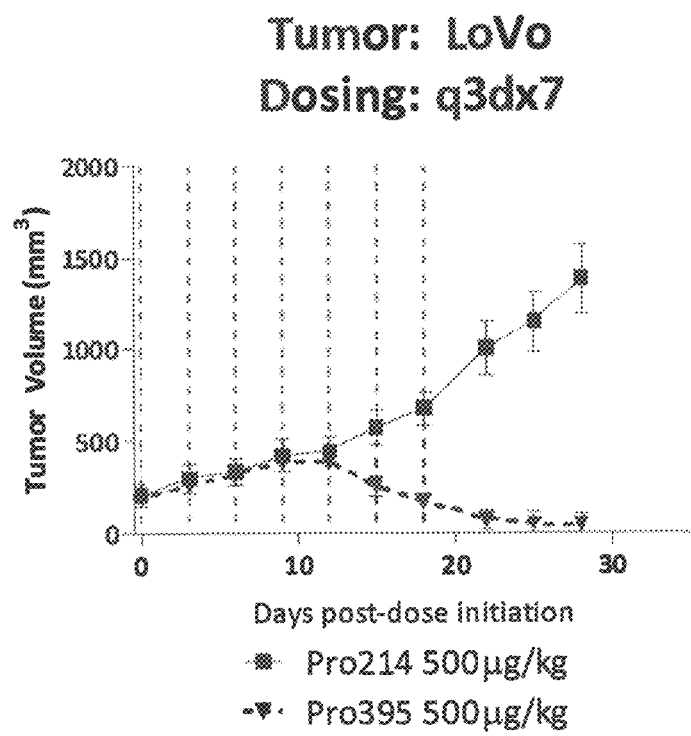

FIG. 125 depicts the results of a tumor regression study using Pro395 which utilizes EGFR targeting and a CathS linker, using the protocol described in FIG. 122. The results show that Pro395 regresses established solid tumors compared to Pro214 the non-cleavable control.

Figure 126:
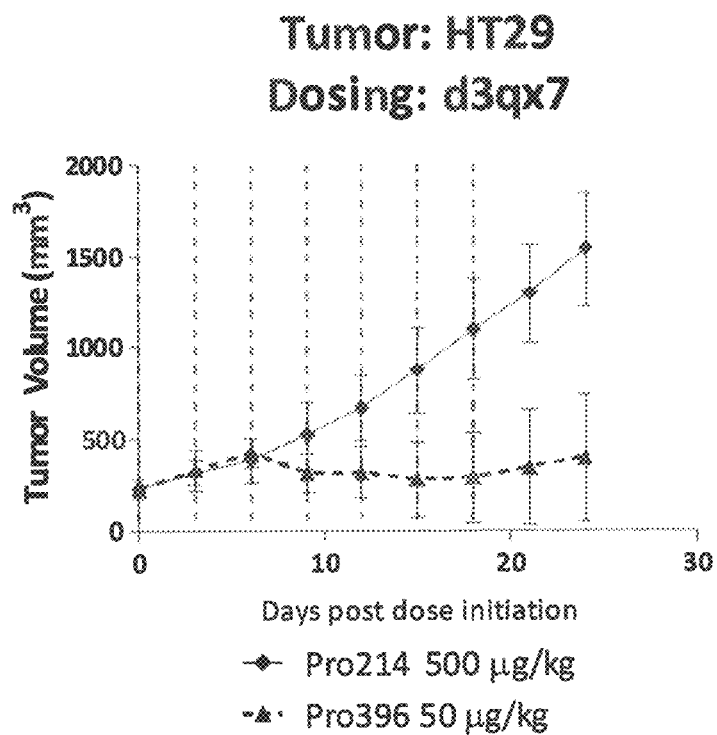

FIG. 126 depicts the results of a tumor regression study using Pro396 which utilizes EGFR targeting and an MMP9v linker, using the protocol described in FIG. 122. The results show that Pro396 demonstrates an anti-tumor response compared to Pro214 the non-cleavable control.

Figure 127:
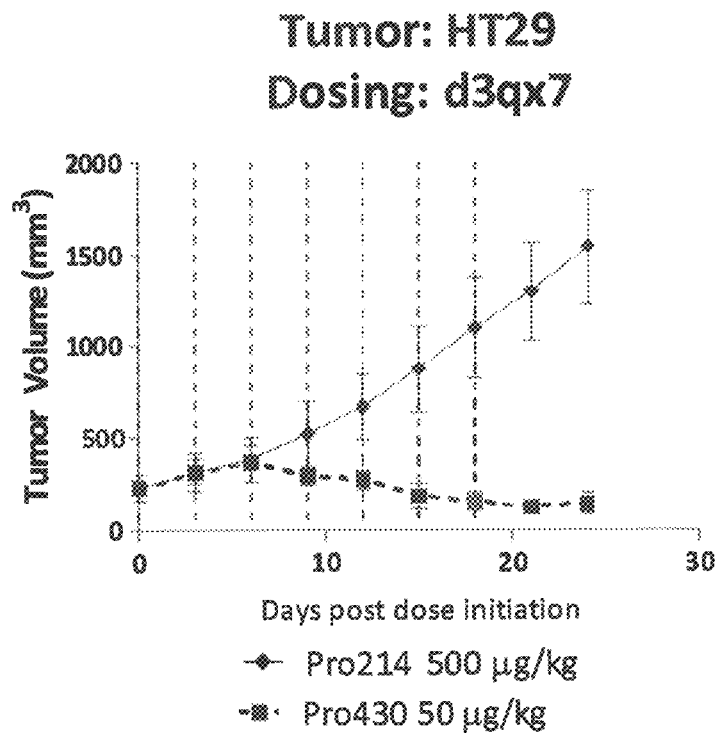

FIG. 127 depicts the results of a tumor regression study using Pro430 which utilizes EGFR targeting and a MMP9-2 linker, using the protocol described in FIG. 122. The results show that Pro430 regresses established solid tumors compared to Pro214 the non-cleavable control.

Figure 128:
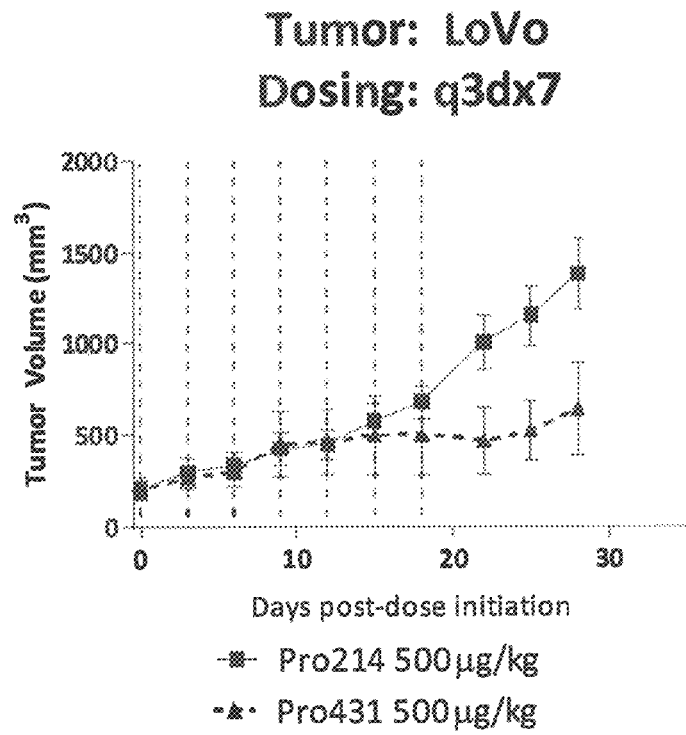

FIG. 128 depicts the results of a tumor regression study using Pro431 which utilizes EGFR targeting and an ST14 MS linker, using the protocol described in FIG. 122. The results show that Pro431 demonstrates an anti-tumor response compared to Pro214 the non-cleavable control.

Figure 129:
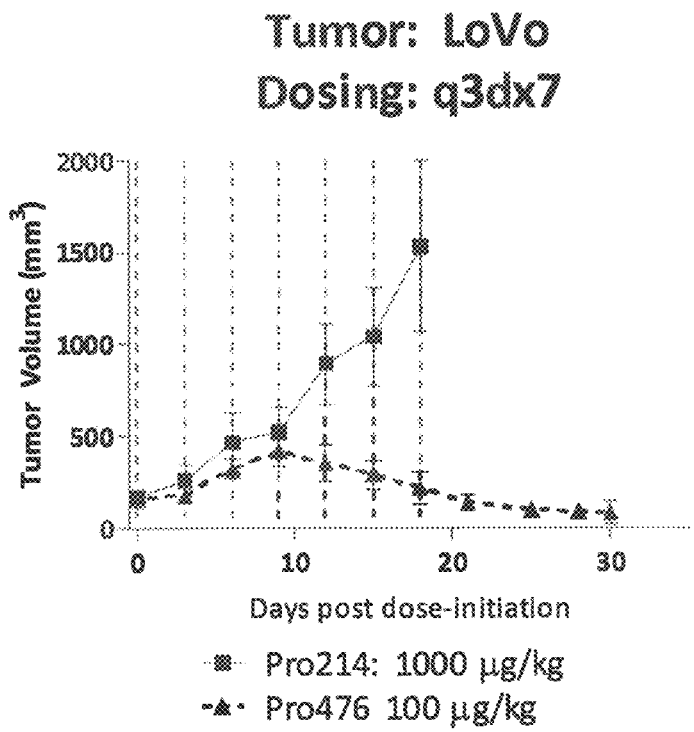

FIG. 129 depicts the results of a tumor regression study using Pro476 which utilizes EGFR targeting, a MMP9-2 linker and the inactive domains Vli2 and VHi2, using the protocol described in FIG. 122. The results show that Pro476 regresses established solid tumors compared to Pro214 the non-cleavable control.

Figure 130:
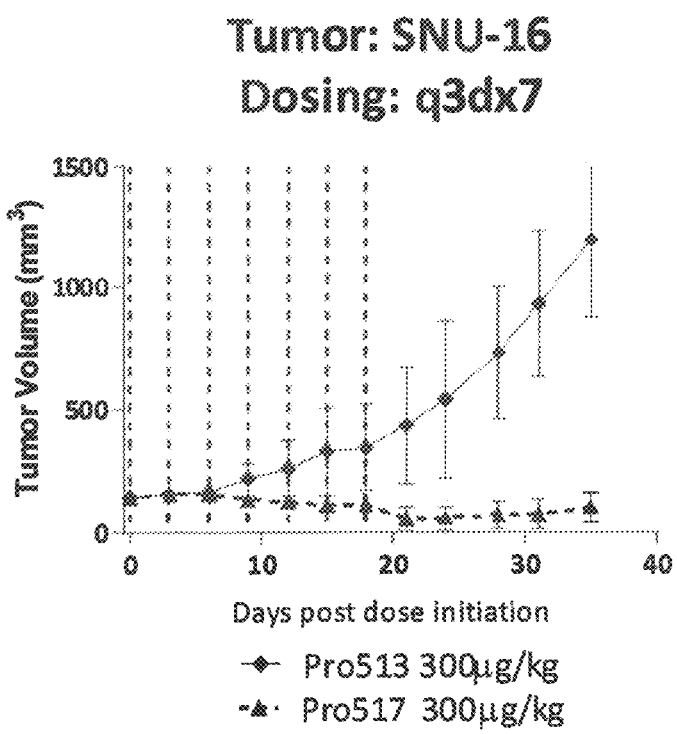

FIG. 130 depicts the results of a tumor regression study using Pro517 which utilizes EGFR targeting and a MMP9-2 linker, using the protocol described in FIG. 122. The results show that Pro517 regresses established solid tumors compared to Pro513 the non-cleavable control.

Figure 131:
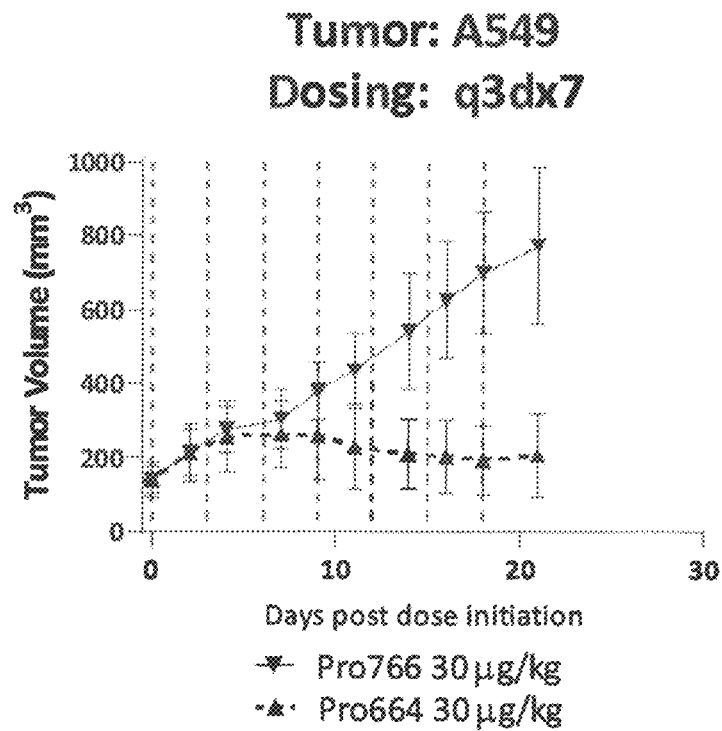

FIG. 131 depicts the results of a tumor regression study using Pro664 which utilizes B7H3 targeting and a MMP9 linker, using the protocol described in FIG. 120. The results show that Pro664 regresses established solid tumors compared to Pro766 the non-cleavable control.

Figure 132:
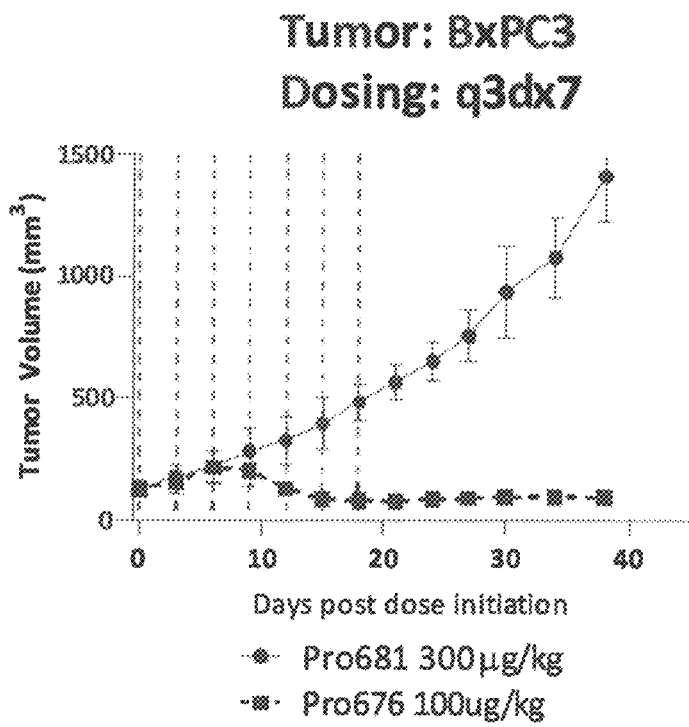

FIG. 132 depicts the results of a tumor regression study using Pro676 which utilizes Trop2 targeting and a MMP9 linker, using the protocol described in FIG. 122. The results show that Pro676 regresses established solid tumors compared to Pro681 the non-cleavable control.

Figure 133:
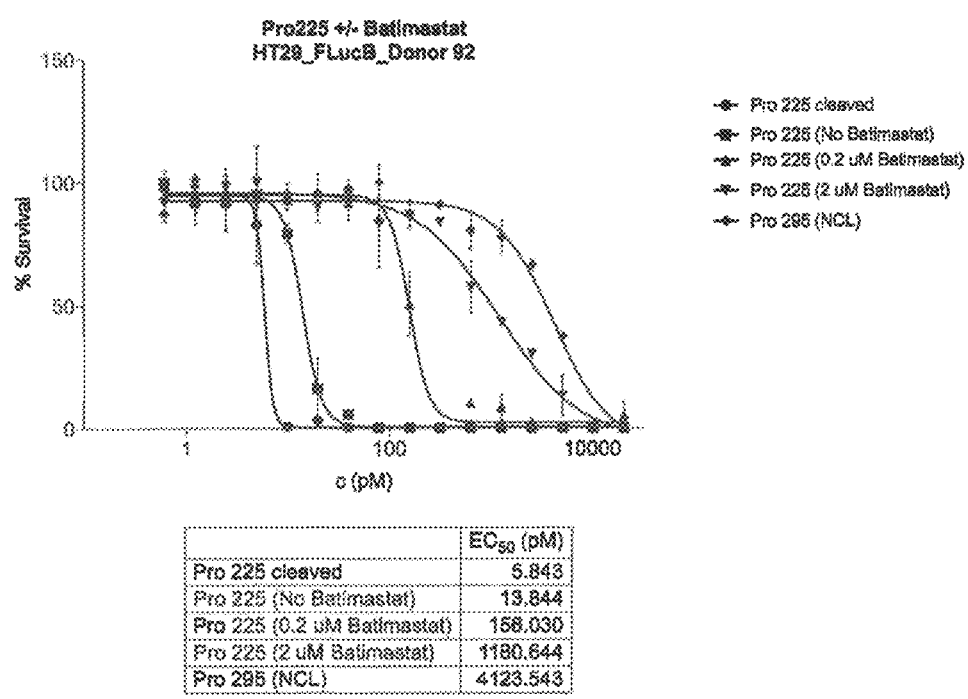

FIG. 133 depicts the results of a study with Pro225 (an anti-B7H3 construct with an MMP9 linker) and increasing amounts of the MMP-specific inhibitor Batimastat, showing that the potency of the uncleaved Pro225 is reduced by Batimastat, demonstrating in-assay COBRA cleavage and activation by cells.

DETAILED DESCRIPTION OF THE INVENTION

Introduction

The present invention is directed to methods of reducing the toxicity and side effects of bispecific antibodies (including antibody-like functional proteins) that bind to important physiological targets such as CD3 and tumor antigens. Many antigen binding proteins, such as antibodies, can have significant side effects by targeting normal tissues, and thus there is a need to only activate the binding capabilities of a therapeutic molecule in the vicinity of the disease tissue, to avoid normal tissue interactions. Accordingly, the present invention is directed to multivalent conditionally effective ("MCE") proteins that have a number of functional protein domains. In general, one of these domains is an antigen binding domain (ABD) that will bind a target tumor antigen (TTA), and another is an ABD that will bind a T-cell antigen such as CD3 under certain conditions. Additionally, the MCE proteins also include one or more protease cleavage sites. That is, the therapeutic molecules are made in a "pro-drug" like format, wherein the CD3 binding domain is inactive until exposed to a tumor environment. The tumor environment contains proteases, such that upon exposure to the protease, the prodrug is cleaved and becomes active.

This is generally accomplished herein by using proteins that include a "pseudo" variable heavy domain and a "pseudo" variable light domain directed to the T-cell antigen such as CD3, that restrain the CD3 Fvs of the MCE into an inactive format as is discussed herein. As the TTA targets the MCE into the proximity of the tumor, the MCE is thus exposed to the protease. Upon cleavage, the active variable heavy domain and active light domain are now able to pair to form one or more active ABDs to CD3 and thus recruit T cells to the tumor, resulting in treatment.

In general, the CD3 binding domain ("Fv") is in a constrained format, wherein the linker between the active variable heavy domain and the active variable light domain that traditionally form an Fv is too short to allow the two active variable domains to bind each other; this is referred to as "constrained linker"; these can be constrained and cleavable (CCL, as used in Format 1) or constrained and not cleavable (CNCL, as used in Format 2). Rather, in the prodrug (e.g., uncleaved) format, the prodrug polypeptide also comprises a "pseudo Fv domain". The pseudo Fv domain comprises a variable heavy and light domain, with standard framework regions, but "inert" or "inactive" CDRs. The pseudo Fv domain also has a constrained linker between the inactive variable heavy and inactive variable light domains. Since neither Fv nor pseudo Fv domains can self-assemble due to the steric constraints, there is an intramolecular assembly that pairs the aVL with the iVH and the aVH with the iVL, due to the affinity of the framework regions of each. However, due to the "inert" CDRs of the pseudo domain, the resulting ABDs will not bind CD3, thus preventing toxicities outside the diseased tissue, such as a tumor. However, in the presence of proteases that are in or near the tumor, the prodrug construct is cleaved such that the pseudo-Fv domain is released from the surface and thus allows the "real" variable heavy and variable light domains to associate intermolecularly (e.g. two cleaved constructs come together), thus triggering active CD3 binding and the resulting tumor efficacy. These constructs are generally referred to herein as COnditional Bispecific Redirected Activation constructs, or "COBRAs™". The stability of the intramolecular assembly is shown by the conditionality experiments herein, whereby in the absence of protease, the uncleaved constructs have no activity (e.g. no active CD3 binding domain is formed).

Figure 37:
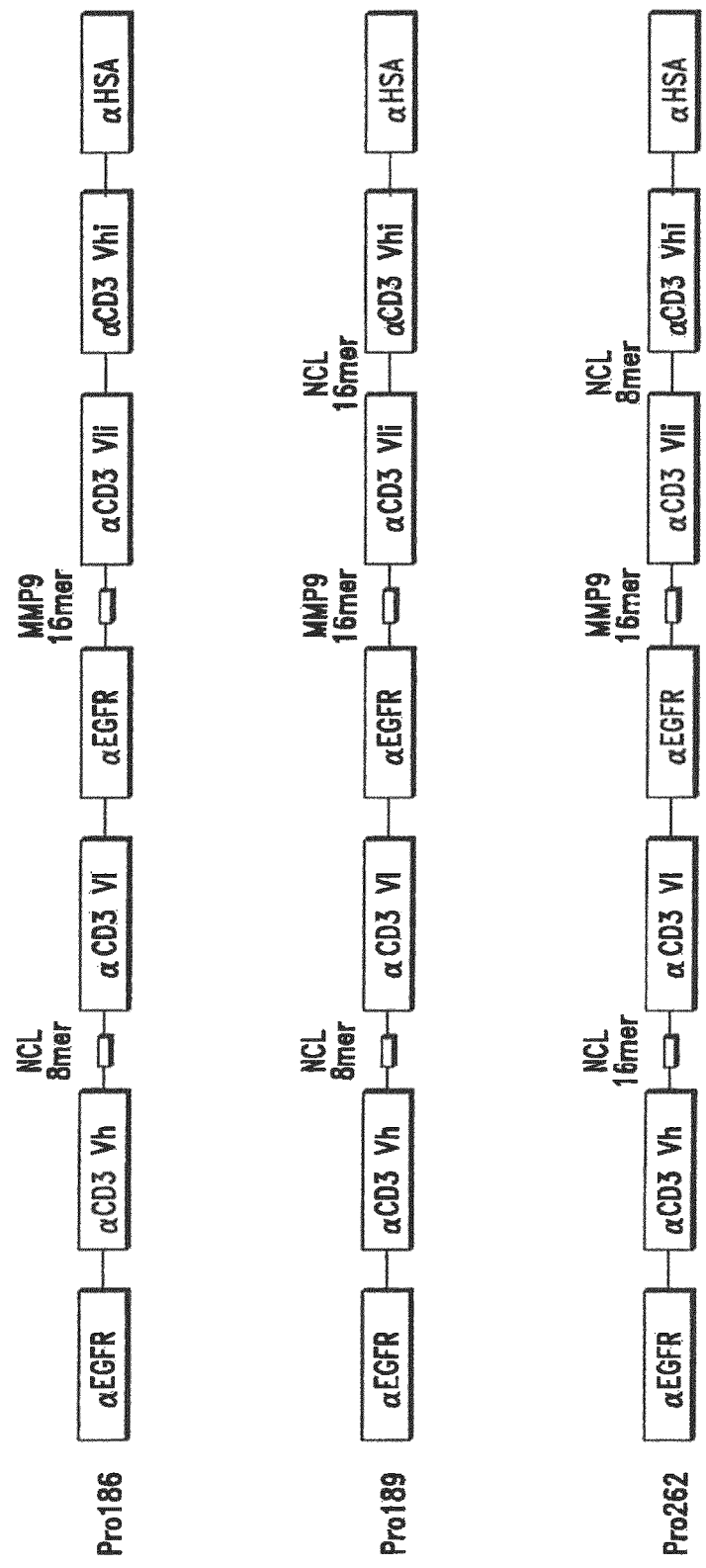
FIG. 37 depicts the schematics for different Format 2 constructs that vary linker length between the Fv domains. These are shown using an MMP9 cleavage site, although others can be used as outlined herein. Similarly, while all of these constructs utilize sdABD-EGFRs for both targeting domains, other sdABDs to different TTAs can be used, and can be the same or different.
Figure 38:
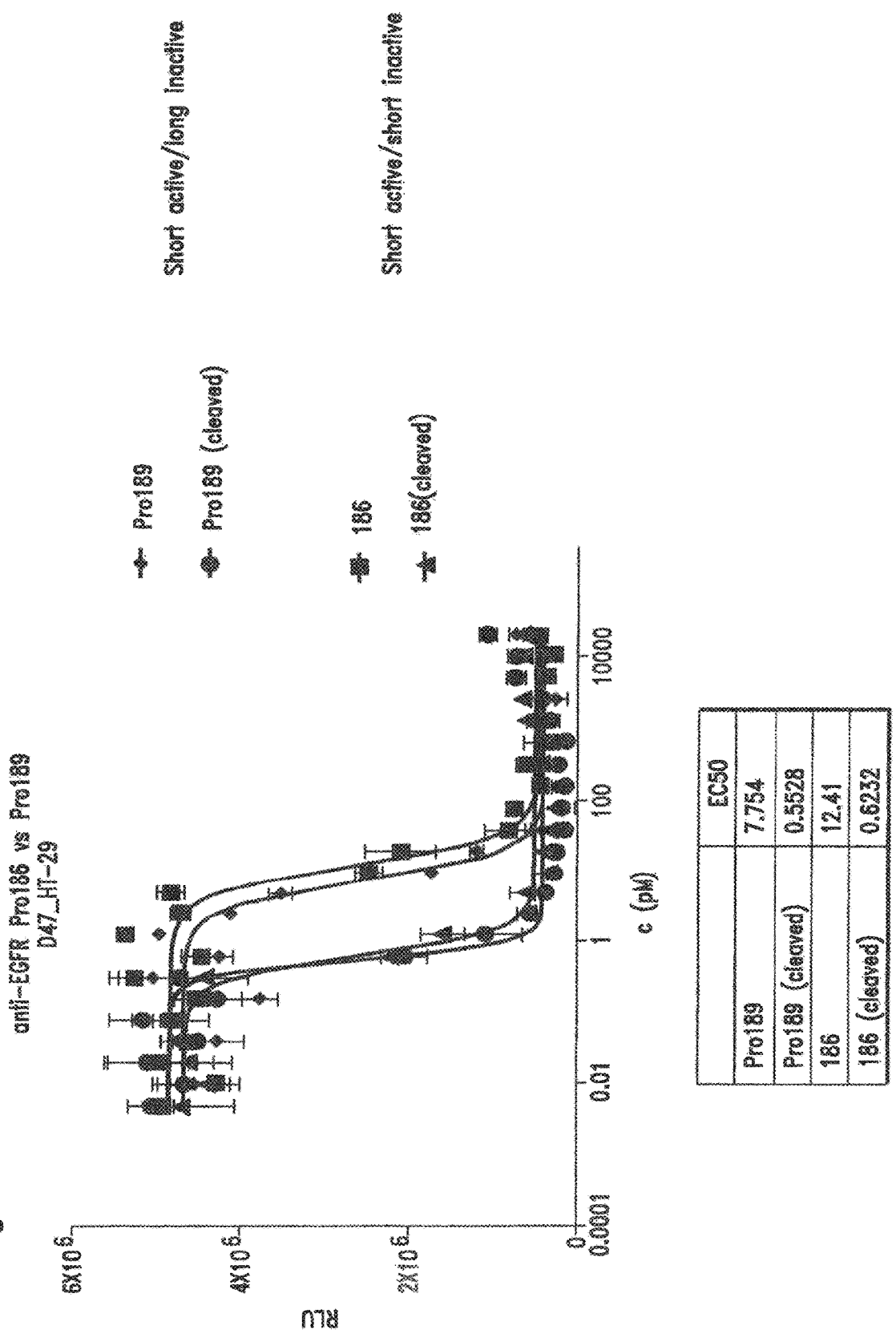
FIG. 38 shows that the linker length for the pseudo Fv can be varied, e.g. that a Format 2 construct with a short linker between the active Fv ("short active") with a longer linker between the pseudo Fv ("long inactive") exhibits similar activity to a "short active" with a "short inactive". Thus conditionality of the COBRA construct is not dependent on both the active and inactive scFv linkers being constrained; as long as one of them is constrained, single chain diabody folding appears to be favored over bivalent scFv folding.
Figure 39:
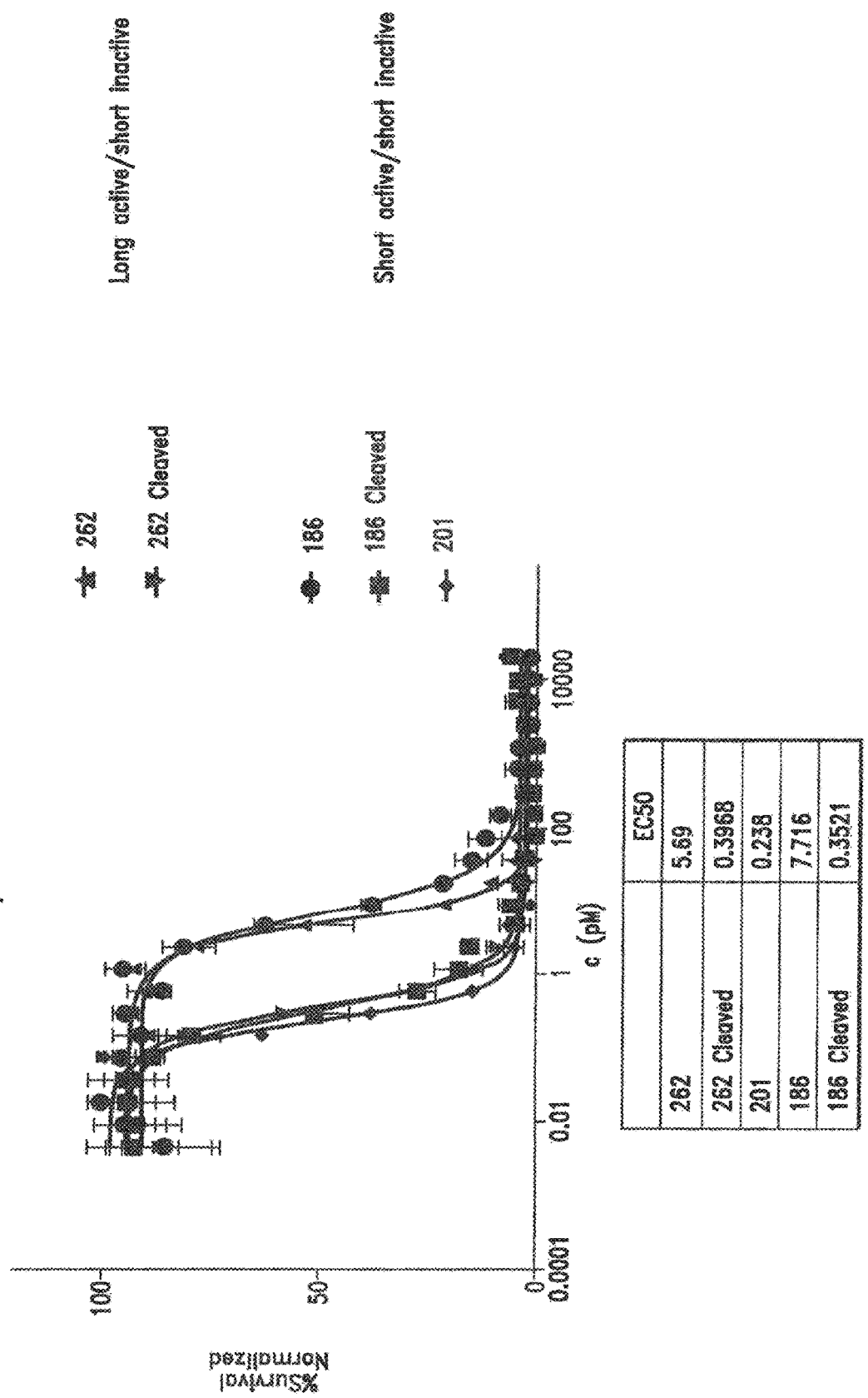
FIG. 39 shows that the linker length for the active Fv can be varied, e.g. that Format 2 constructs with "long active" and "short inactive" behaves similarly to a "short active" and "short inactive" construct. Thus conditionality of the COBRA construct is not dependent on both the active and inactive scFv linkers being constrained; as long as one of them is constrained, single chain diabody folding appears to be favored over bivalent scFv folding.
Figure 40A:
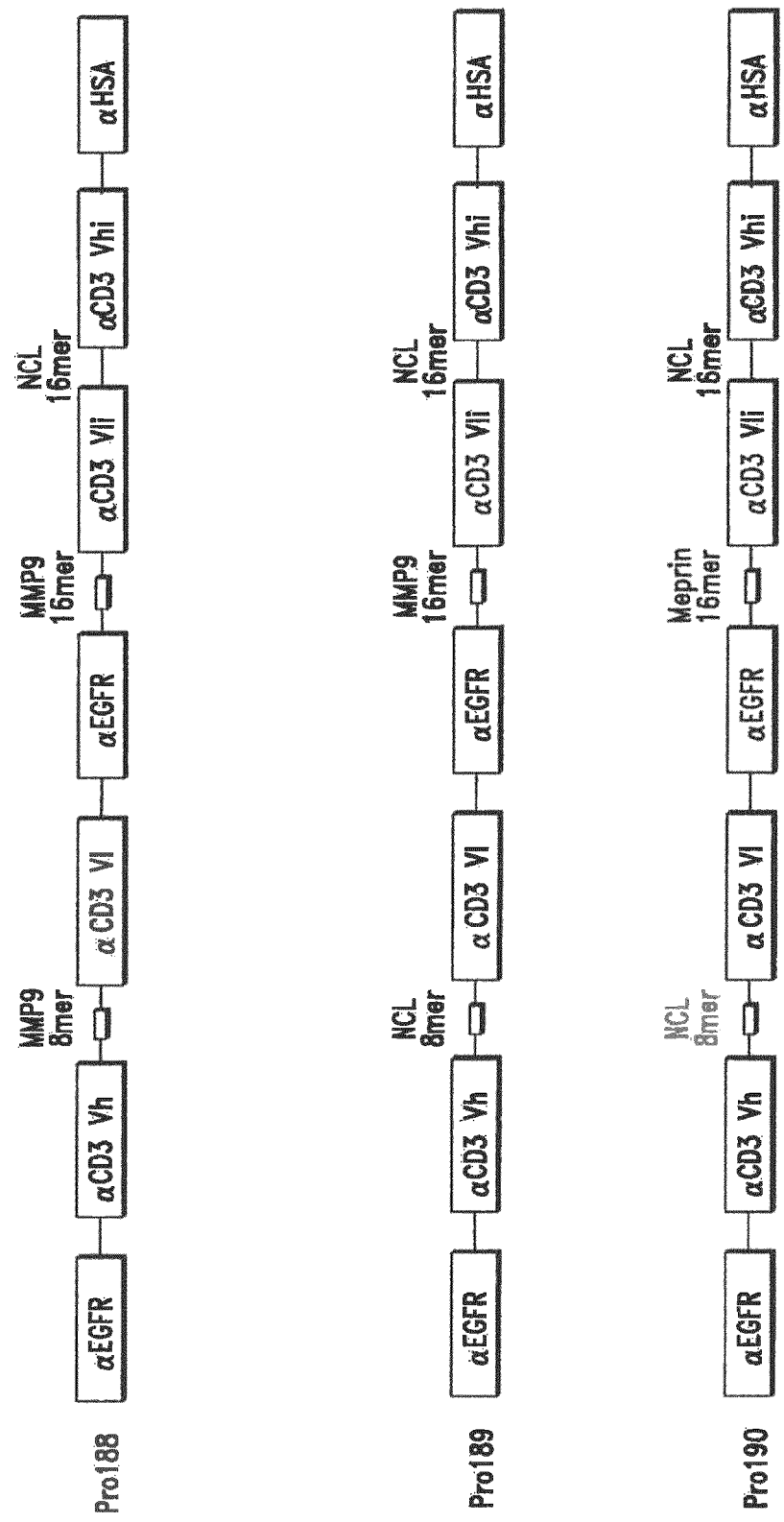
FIG. 40A-FIG. 40C shows the schematics for a number of different constructs. Pro188 is a Format 1 construct which is similar to Pro140 except with a long linker (16mer) in the pseudo Fv. Pro189 and Pro190 (Format 2 constructs) are similar to Pro186 and Pro187 except with a long linker (16mer) in the pseudo Fv domain. Pro191 and Pro192 (also Format 2 constructs) are similar to Pro189 and Pro190 except they have an additional cleavage site upstream of the sdABD(½). Pro193 (Format 4) has a single EGFR targeting domain, the iVH and iVL rearranged to be in reversed order, and an additional cleavage site upstream of the sdABD(½). Pro195 is a Format 2 construct similar to Pro186, with targeting domains that bind to the same TTA, EGFR, but to different epitopes. Pro196, Pro197 and Pro198 are Format 2 constructs with rearranged variable domains.
Figure 40B:
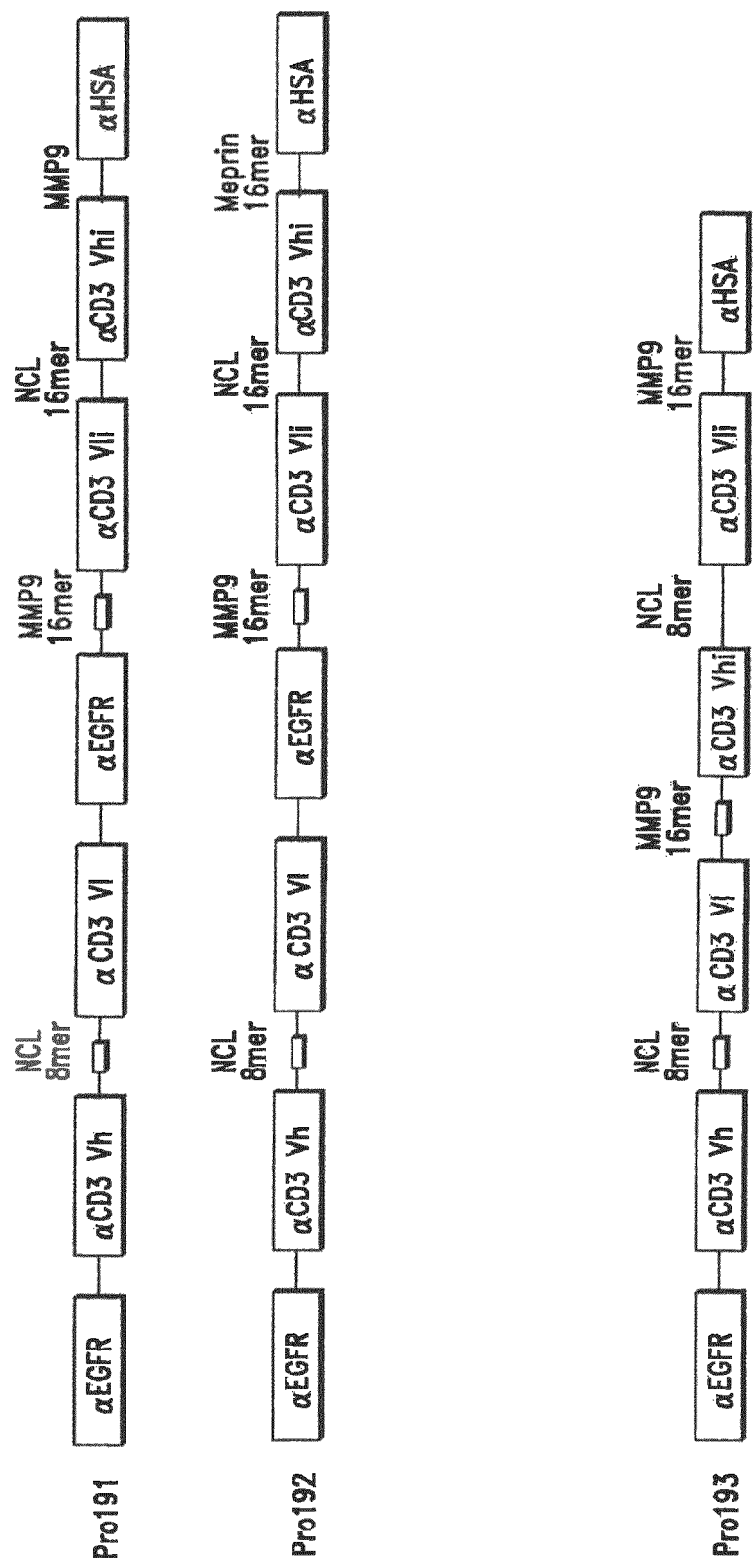
Figure 40C:
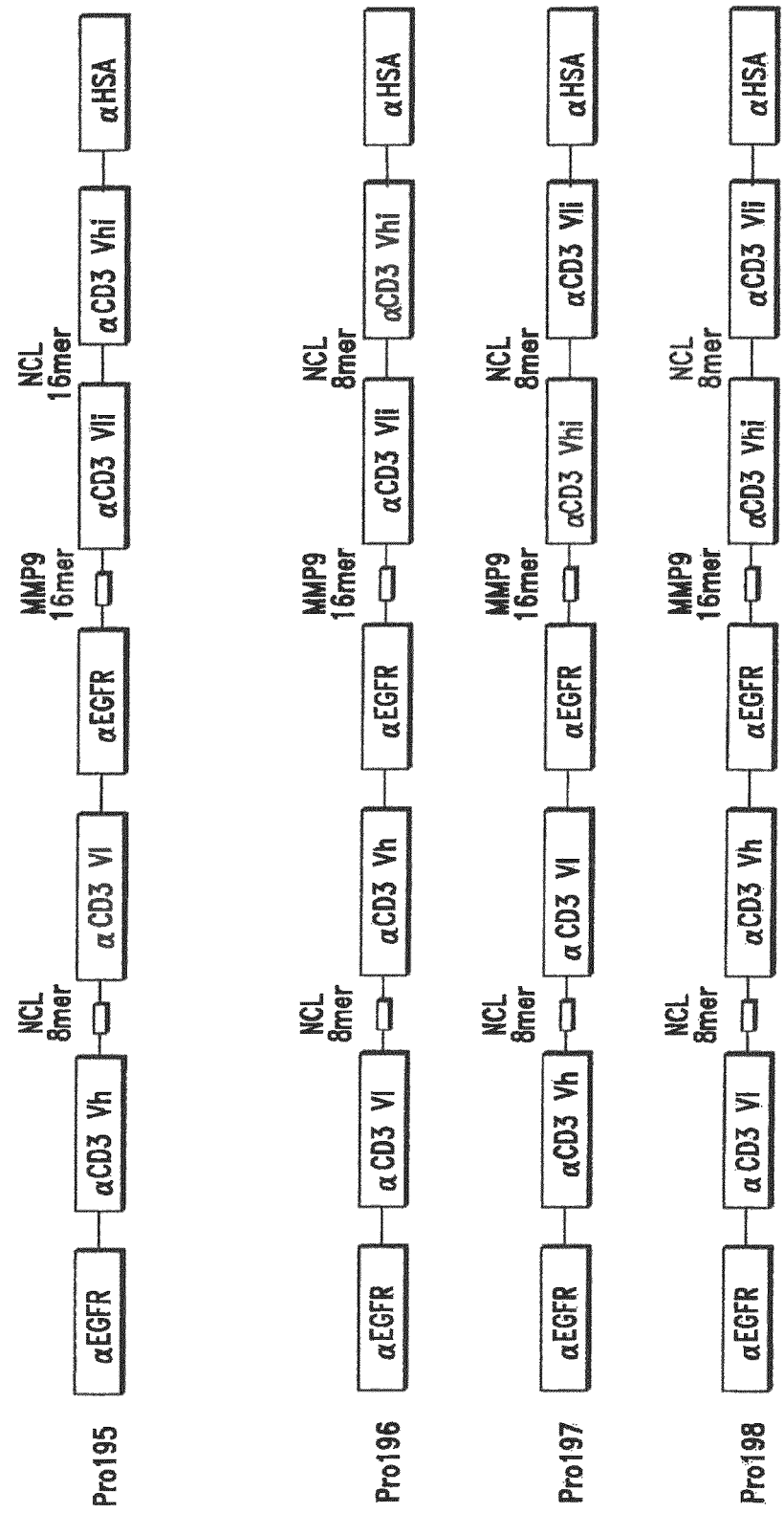
Figure 42:
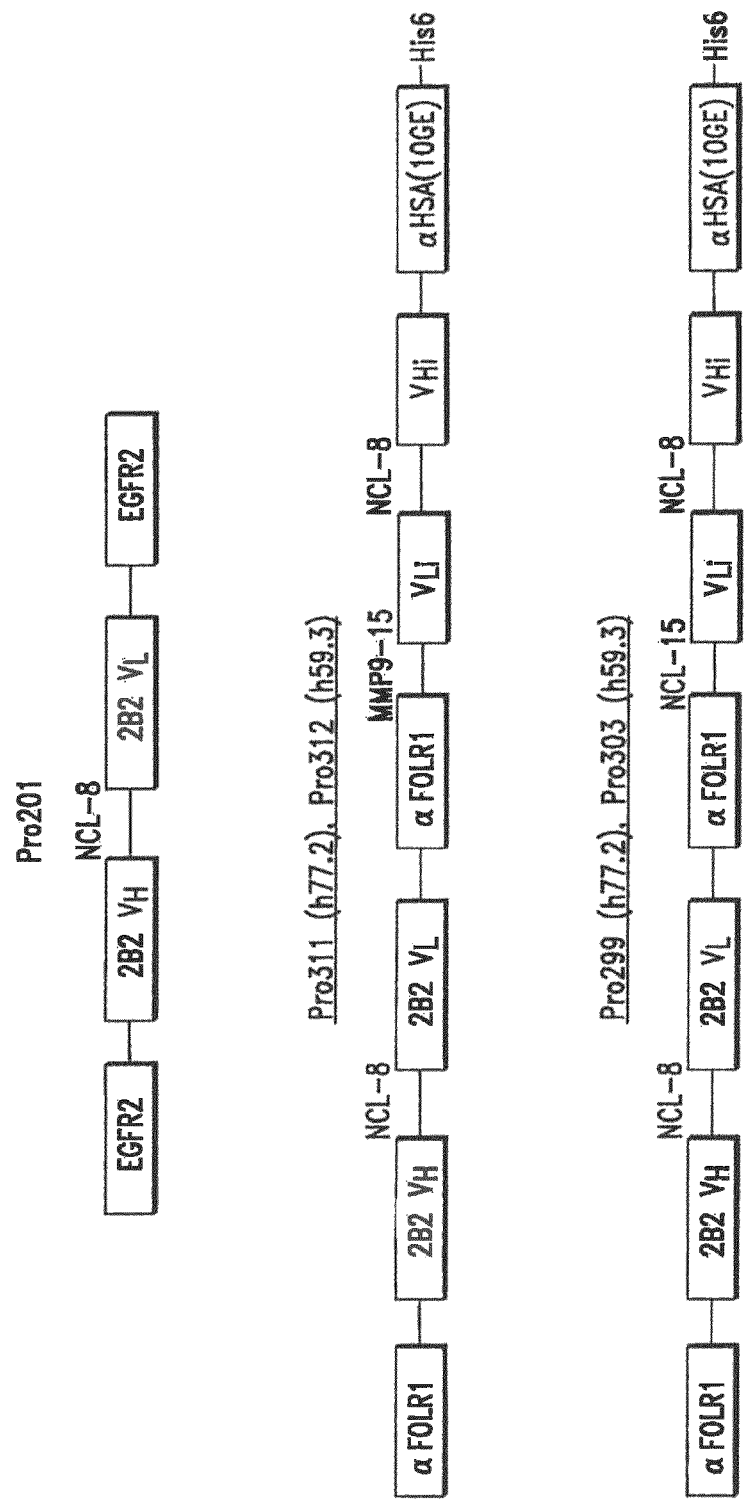
FIG. 42 depicts the schematics for four sdABD-FOLR1 constructs, including the use of the Pro201 active domain dimer as a positive control using sdABD-EGFR2 (with two molecules intermolecularly associating to form two active Fvs against CD3), and two Format 2 test articles, Pro311, using the h77.2 sdABD and Pro312 using the h59.3 sdABD, as well as two negative controls, Pro299, using the h77.2 sdABD and Pro303 using the h59.3 sdABD.
Figure 43:
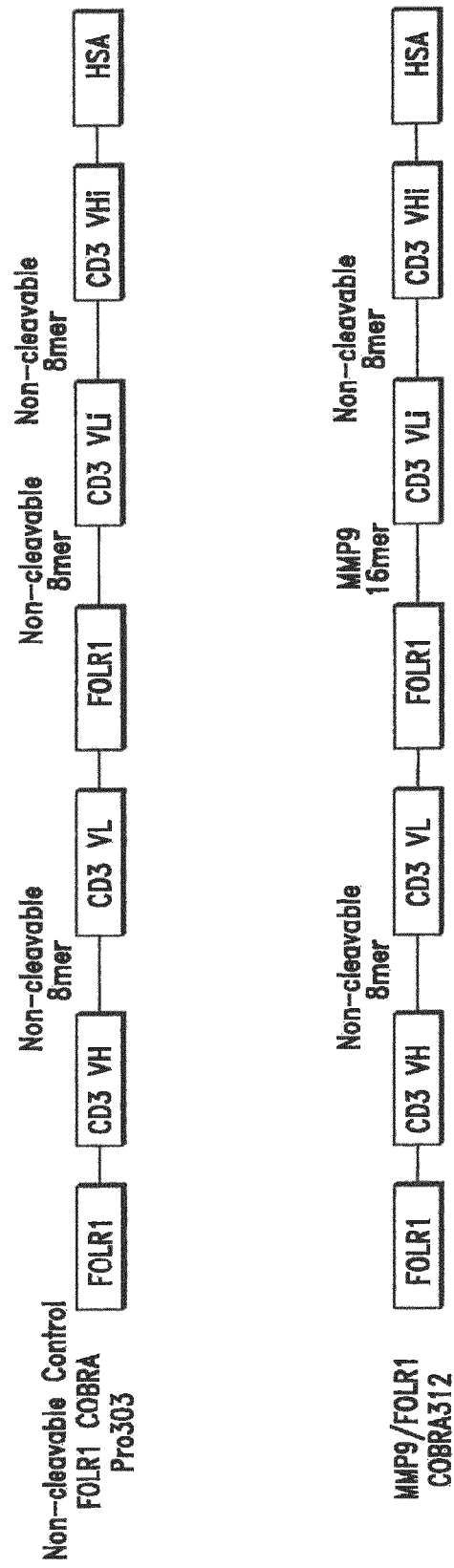
FIG. 43 depicts the schematics of the Format 2 constructs for the FOLR/MMP9 in vivo design.
Figure 44:
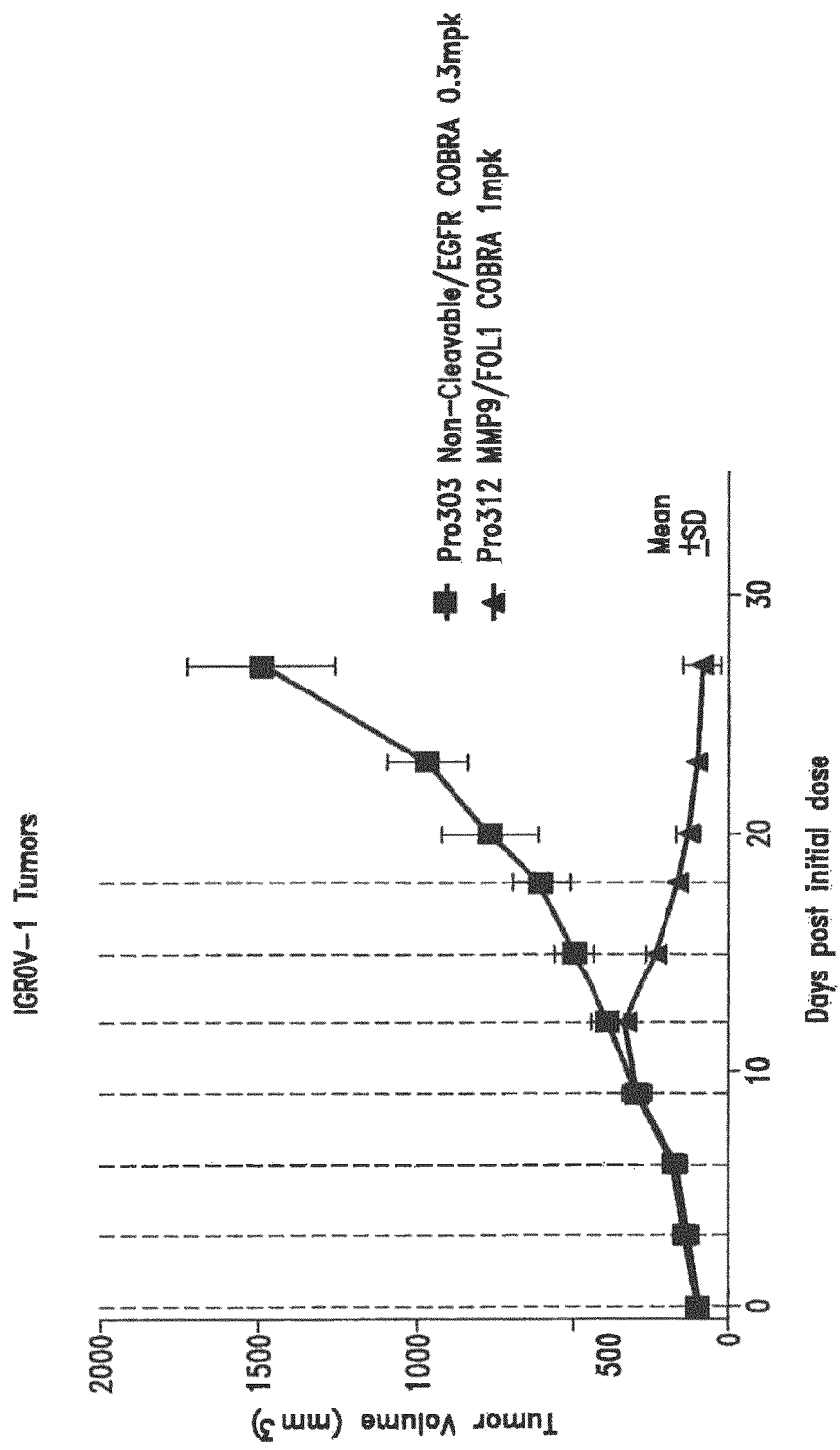
FIG. 44 shows the efficacy of the Pro312 construct in vivo, and demonstrates the MMP9 cleavable linker is necessary for anti-tumor activity.
Figure 45:
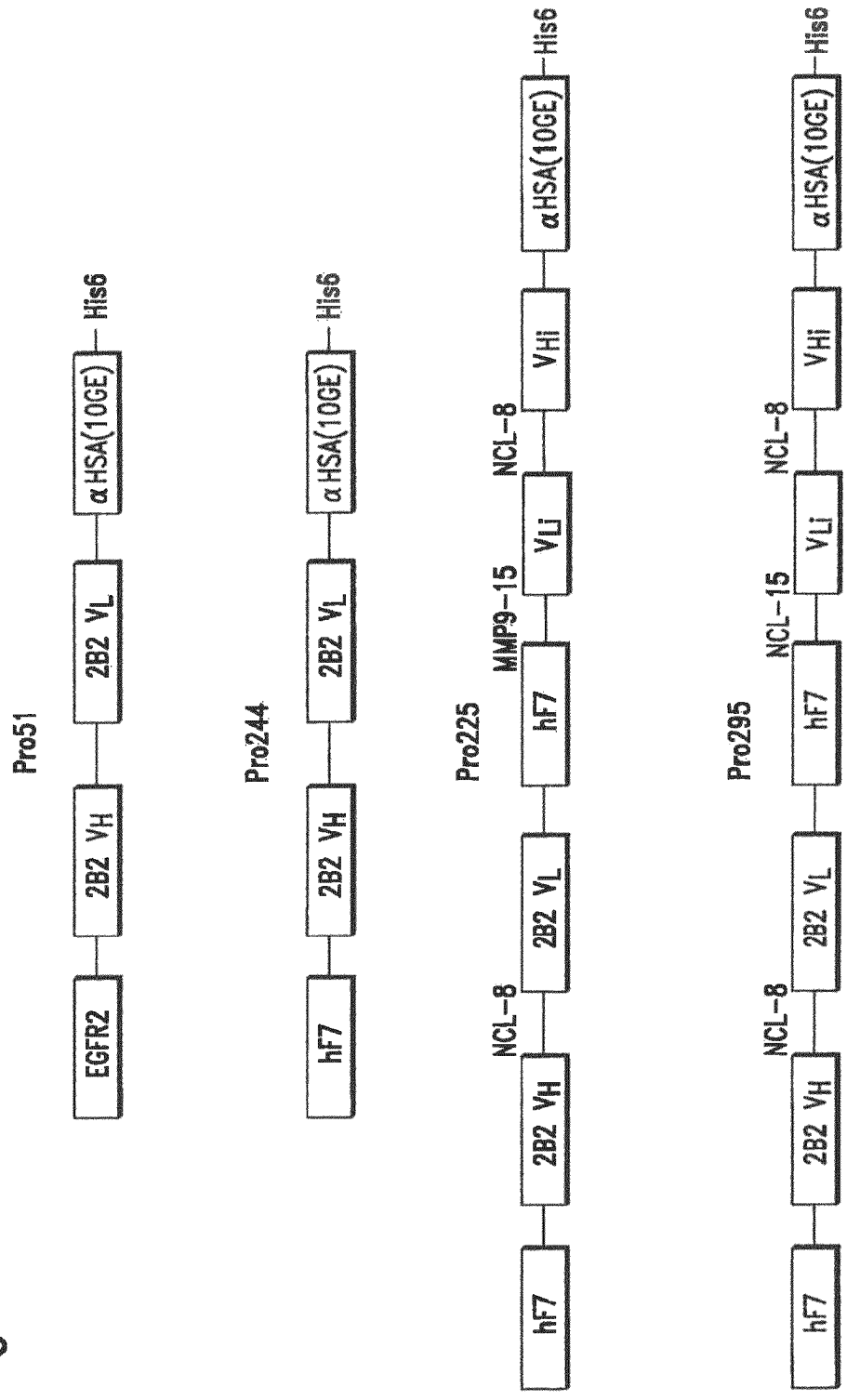
FIG. 45 depicts the schematics of some formats using sdABDs to human B7H3 (sdABD-B7H3), including Pro244, the positive control (using sdABD-B7H3 (hF7), and two Format 2 test articles, Pro225, a Format 2 construct, and Pro295, the negative control lacking a cleavage site.
Figure 46:
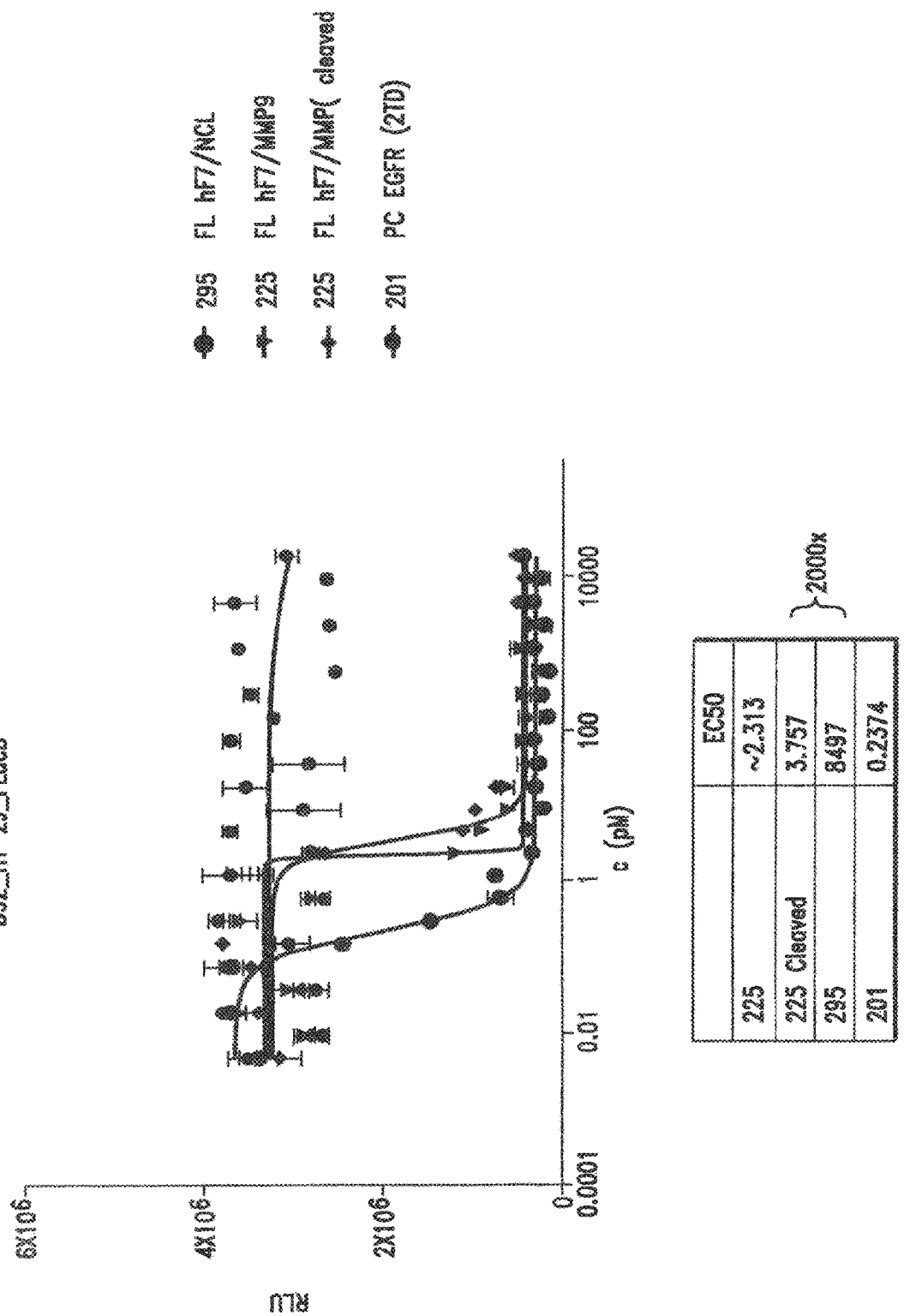
FIG. 46 shows that Pro225 has great conditionality as compared to the control, Pro295.
Figure 47:
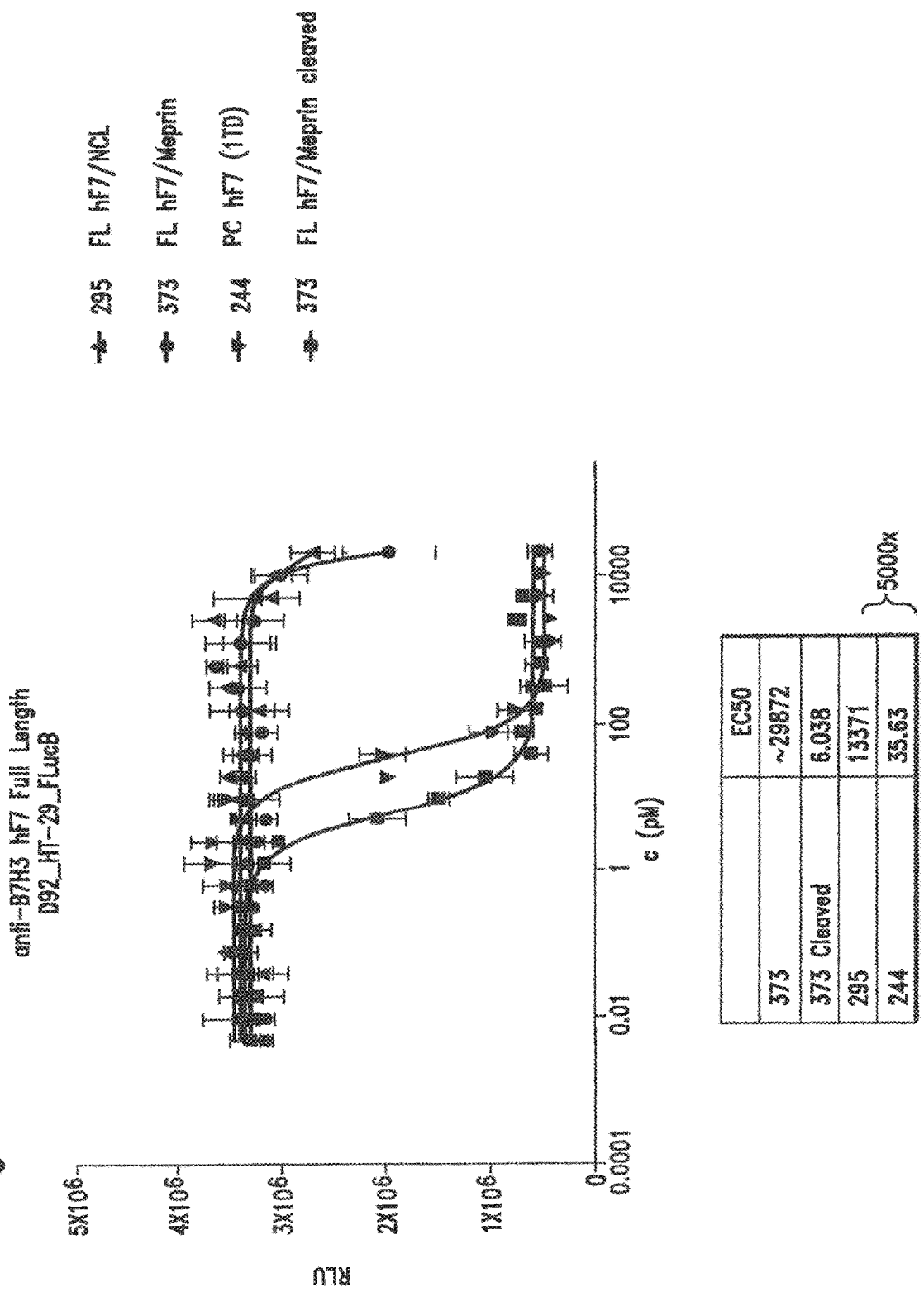
FIG. 47 shows that a Format 2 construct of using a meprin linker, Pro373, shows great conditionality compared to Pro295.
Figure 48:
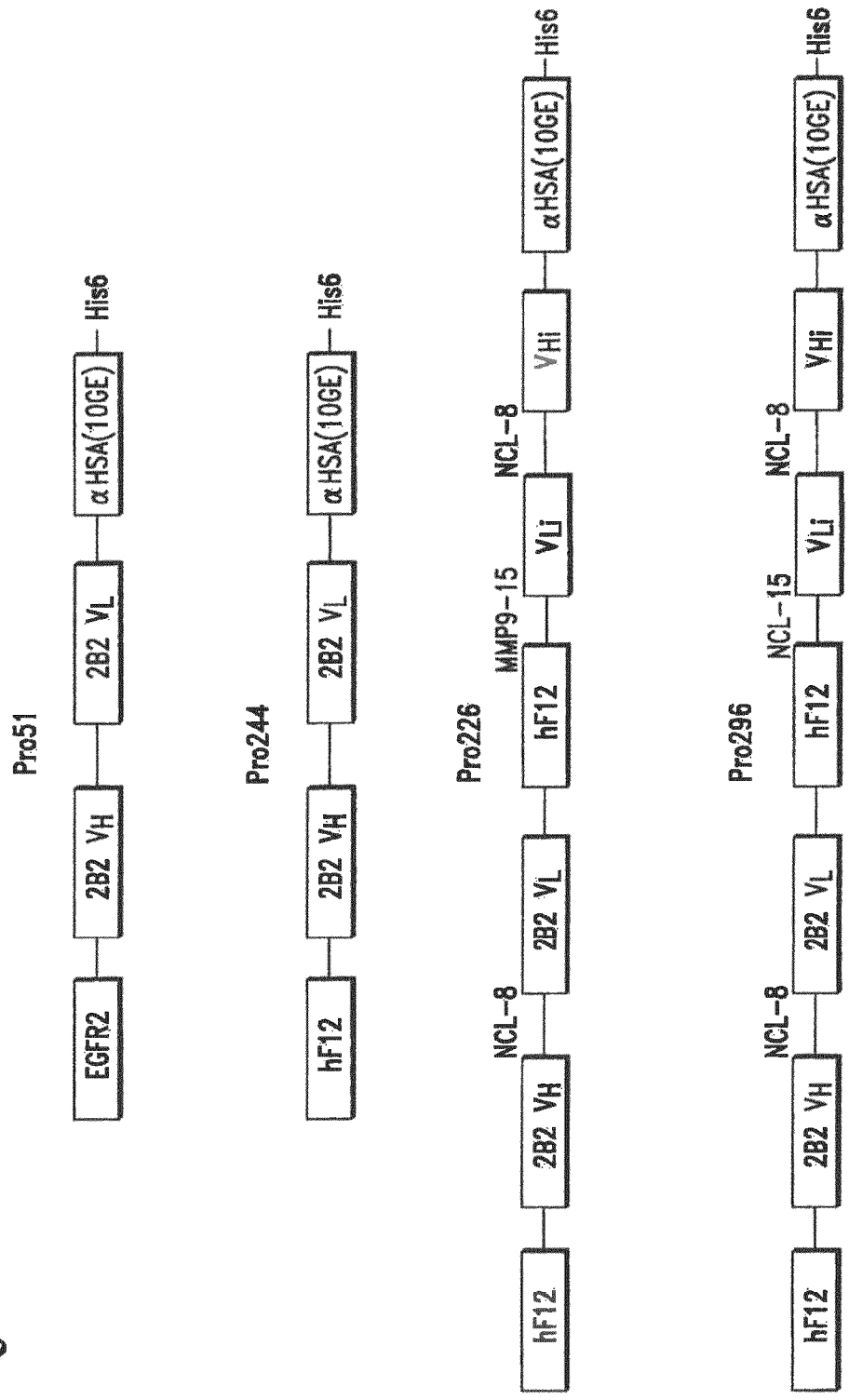
FIG. 48 depicts a number of sdABD-B7H3 (using the hF12 sequence) constructs, showing the Pro51 positive control using sdABD-EGFR, the Pro244 positive control using sdABD-hF12 B7H3, the test construct, Pro226, and the negative control Pro296 without a cleavage site.
Figure 49:
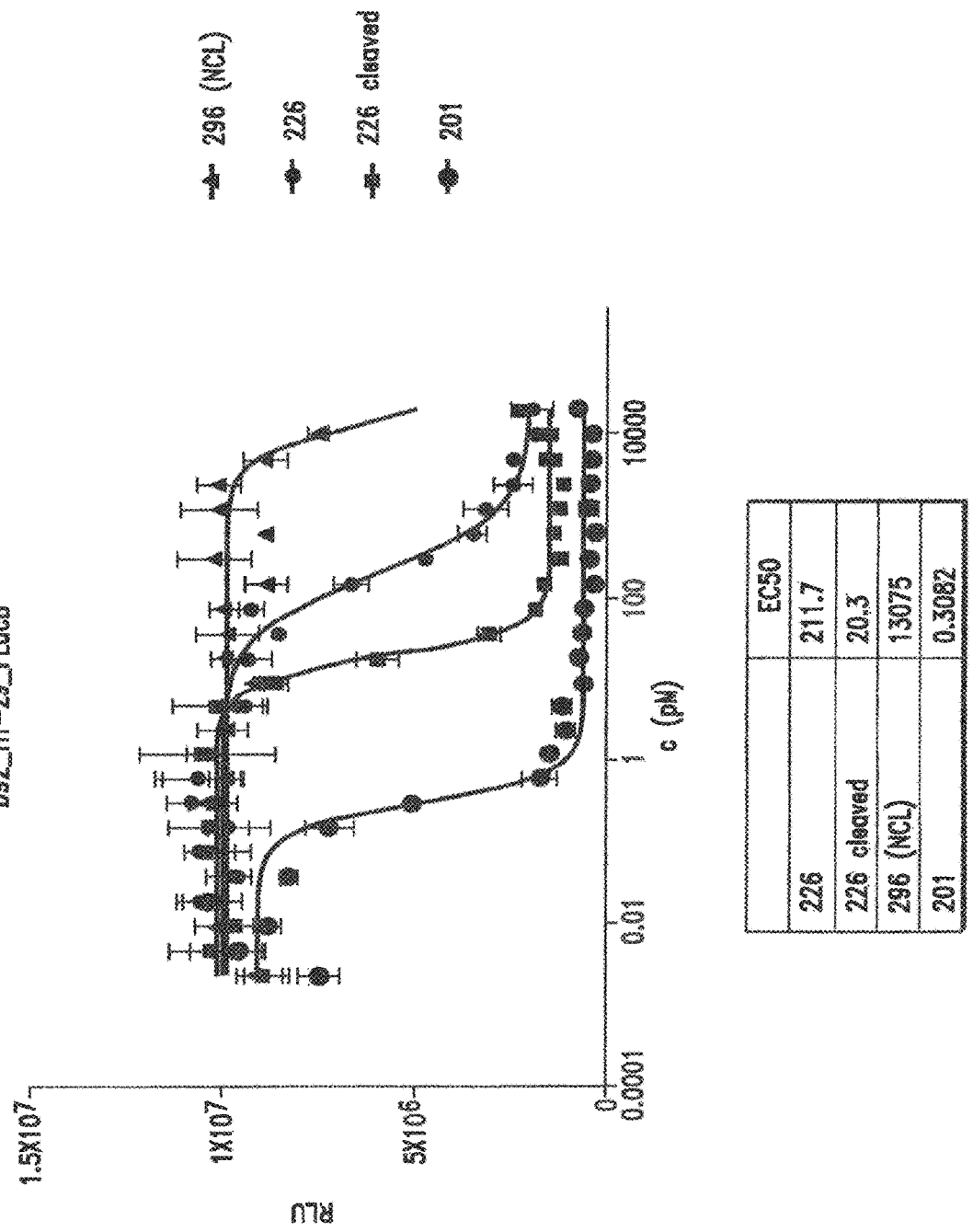
FIG. 49 shows the good conditionality of the Pro226 construct in a TDCC assay.
Figure 51:
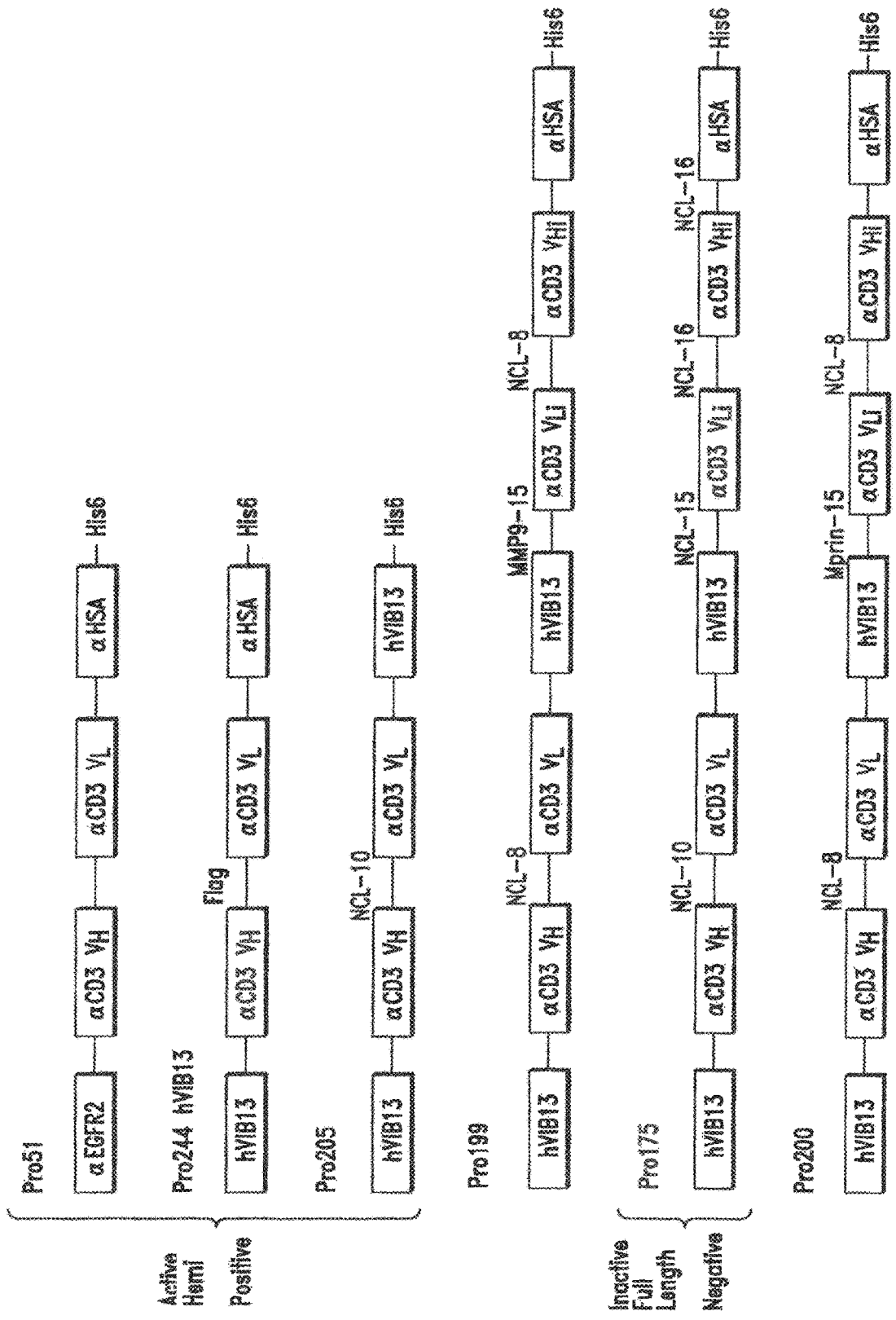
FIG. 51 shows the schematics of a number of Formats: Pro244 is a standard T cell engager positive control and Pro205 is an active domain dimer positive control, Pro199 is a Format 2 construct and Pro175 is the negative control.
Figure 52:
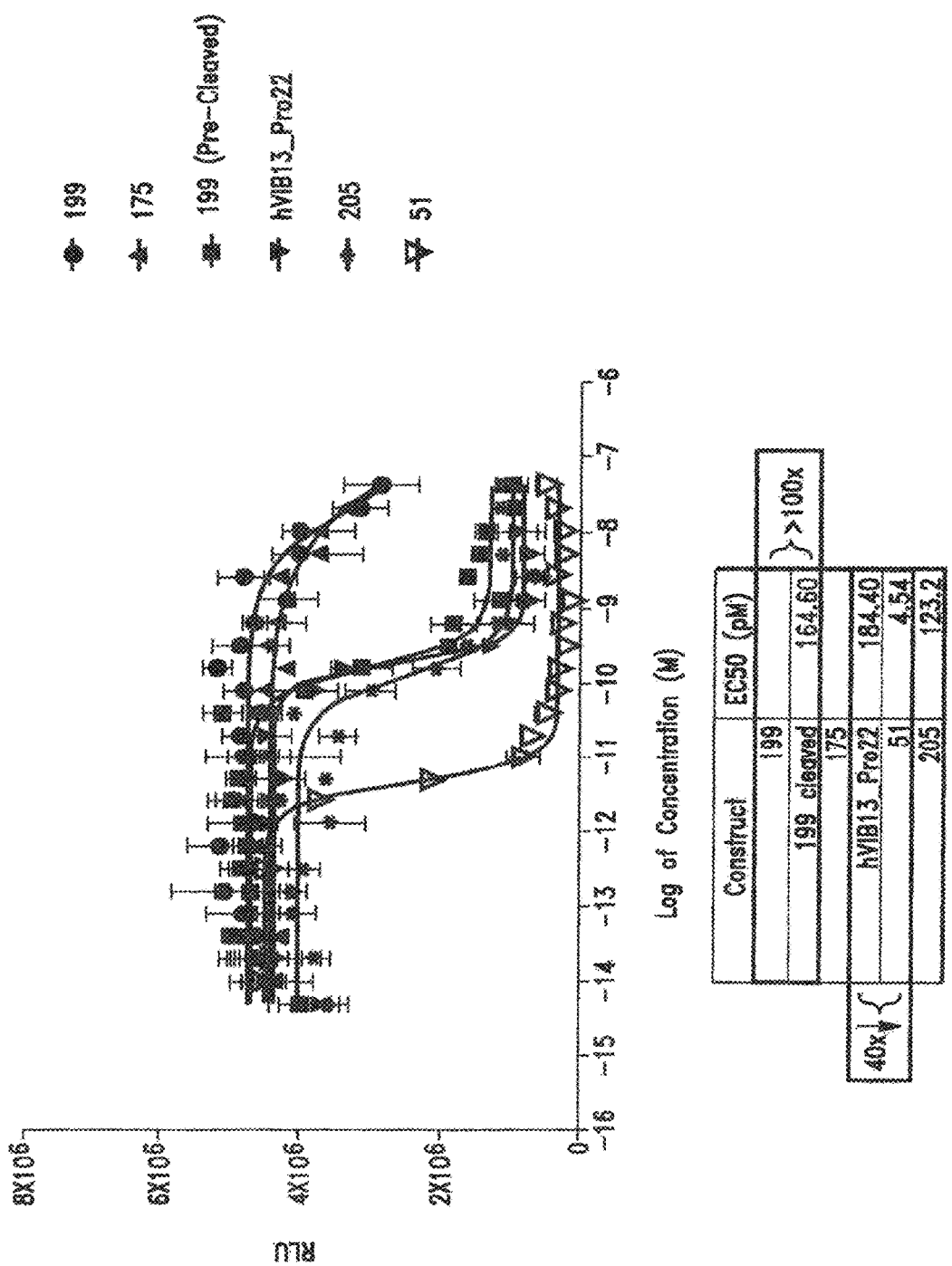
FIG. 52 shows the TDCC activity of sdABD-EpCAM constructs, showing good conditionality.
Figure 53A:
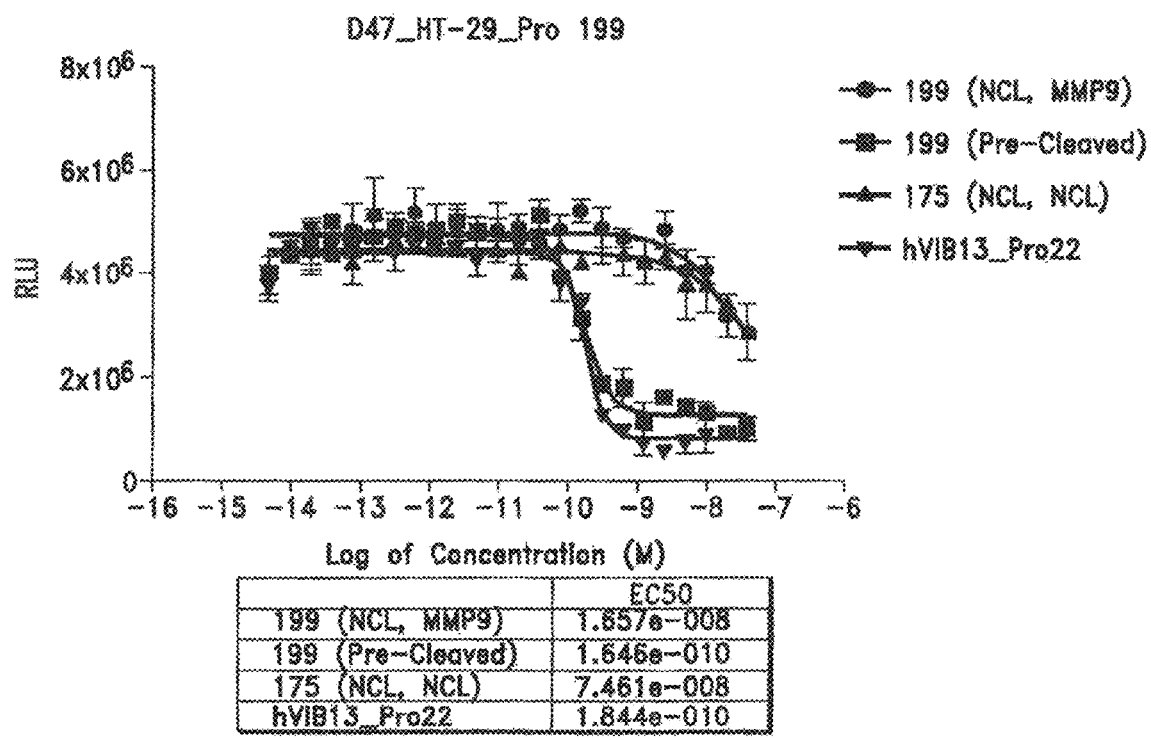
FIG. 53A-FIG. 53B shows the TDCC activity of sdABD-EpCAM Pro199 construct, showing good conditionality in HT29 and LoVo cell models.
Figure 53B:
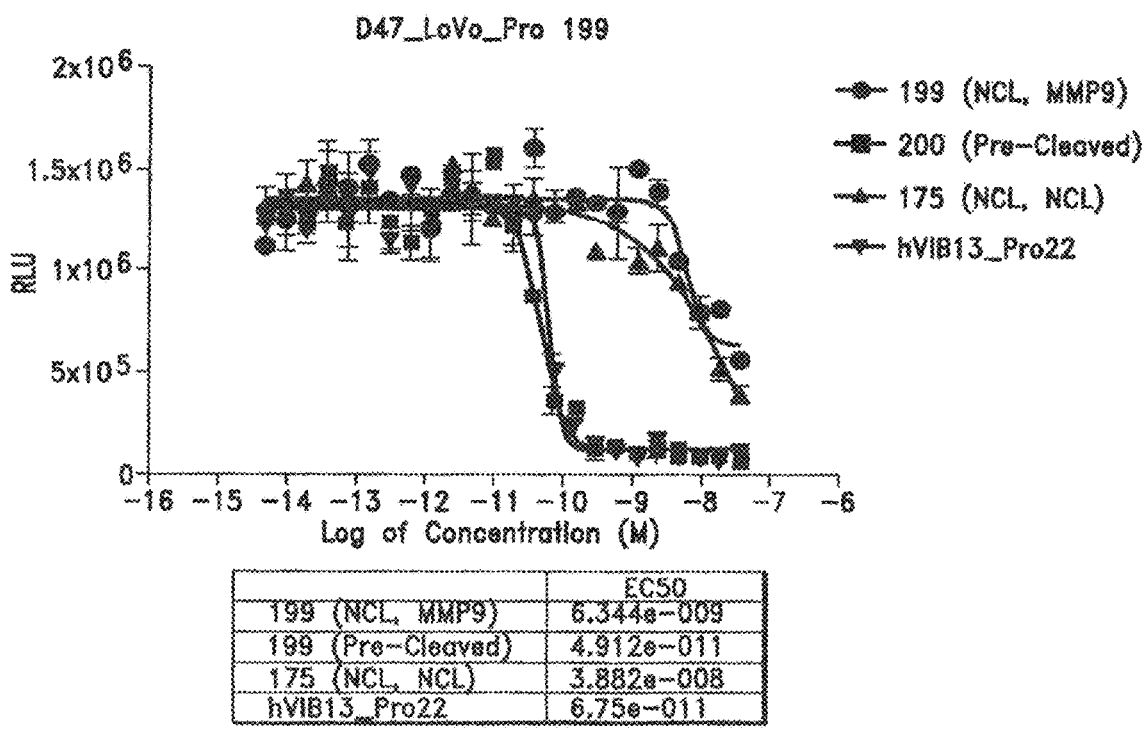
Figure 54A:
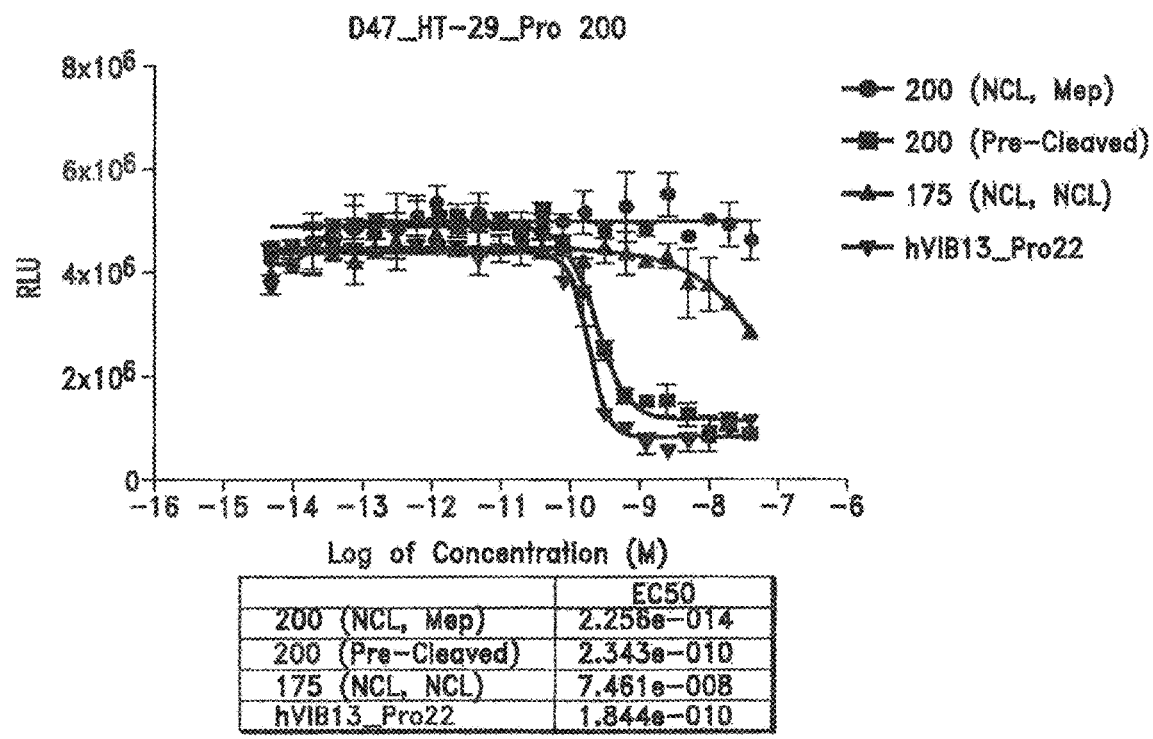
FIG. 54A-FIG. 54B shows the TDCC activity of sdABD-EpCAM Pro200 construct, showing good conditionality in HT29 and LoVo cell models.
Figure 54B:
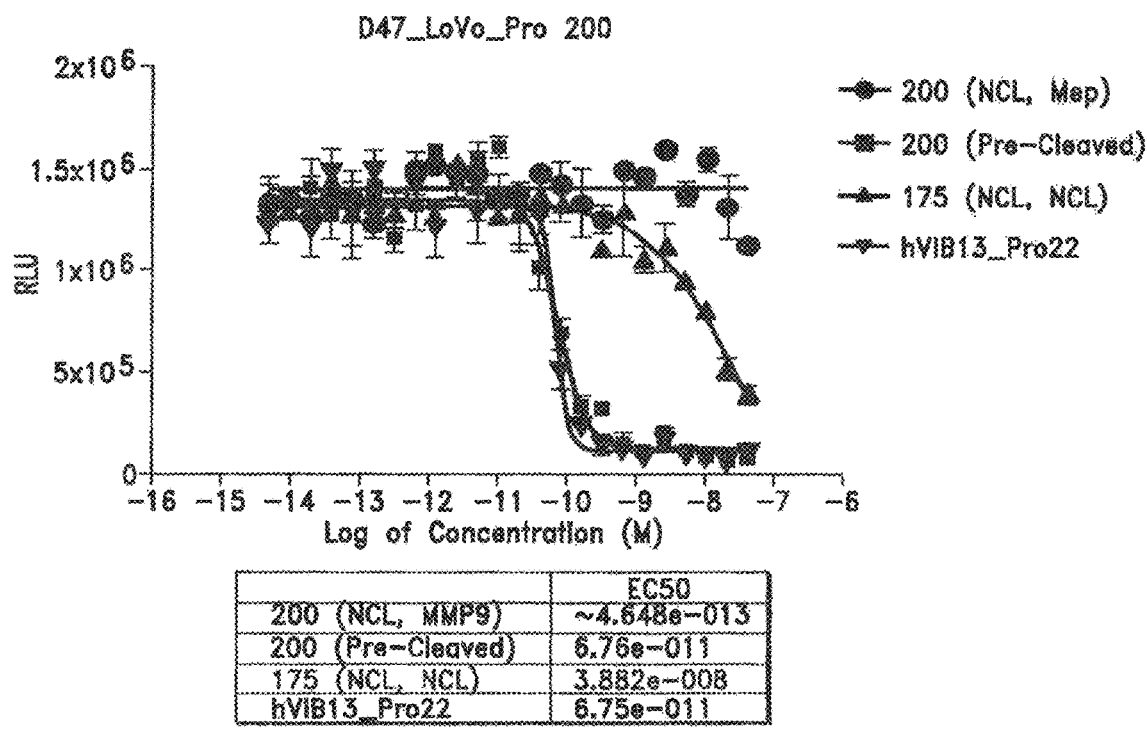
Figure 55:
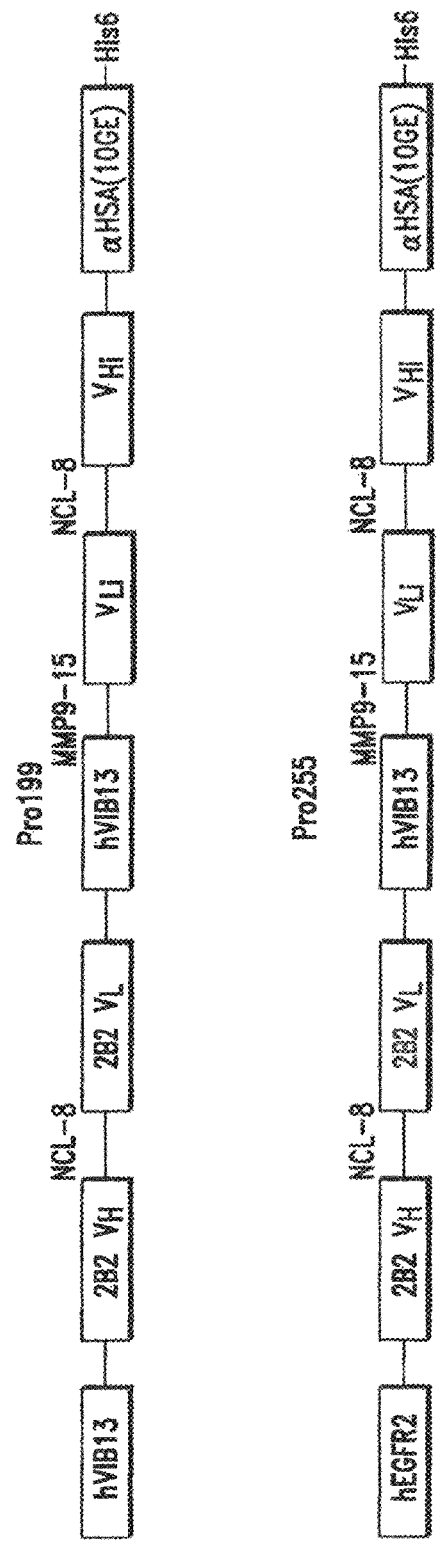
FIG. 55 shows a schematic of Pro255, which uses two different sdABD-TTA, one to EGFR (sdABD-EGFR) and the other to EpCAM (sdABD-EpCAM), as compared to Pro199, with dual EpCAM sdABDs. These are sometimes referred to herein as "hetero-targeting" constructs, in this case, a Format 2 construct.
Figure 56:
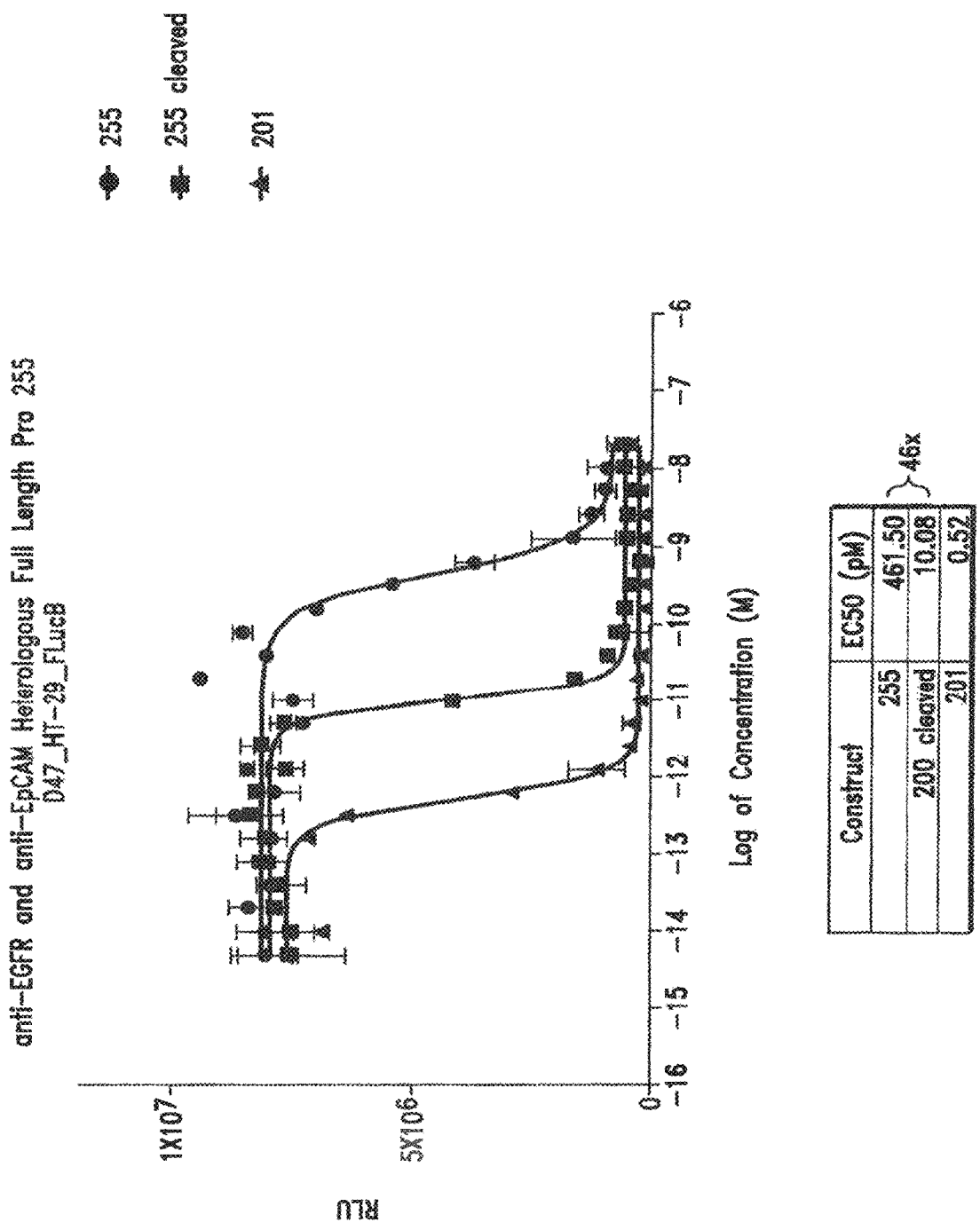
FIG. 56 shows that the Pro255 dual targeting molecule with an MMP9 cleavage site, shows good conditionality.
Figure 57A:
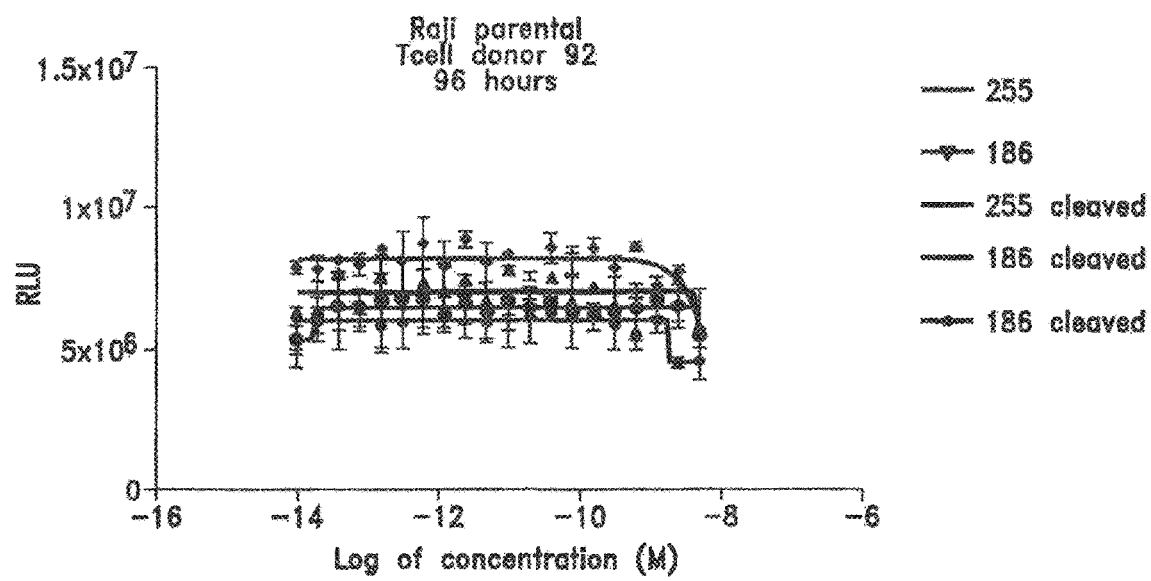
FIG. 57A-FIG. 57D shows the results of experiments on three different cell types. First, Raji transfectants were created with similar expression levels of EpCAM, EGFR and EpCAM+EGFR (data not shown). Then Pro255, which targets both EpCAM and EGFR, was tested in TDCC assays using each cell type.
Figure 57B:
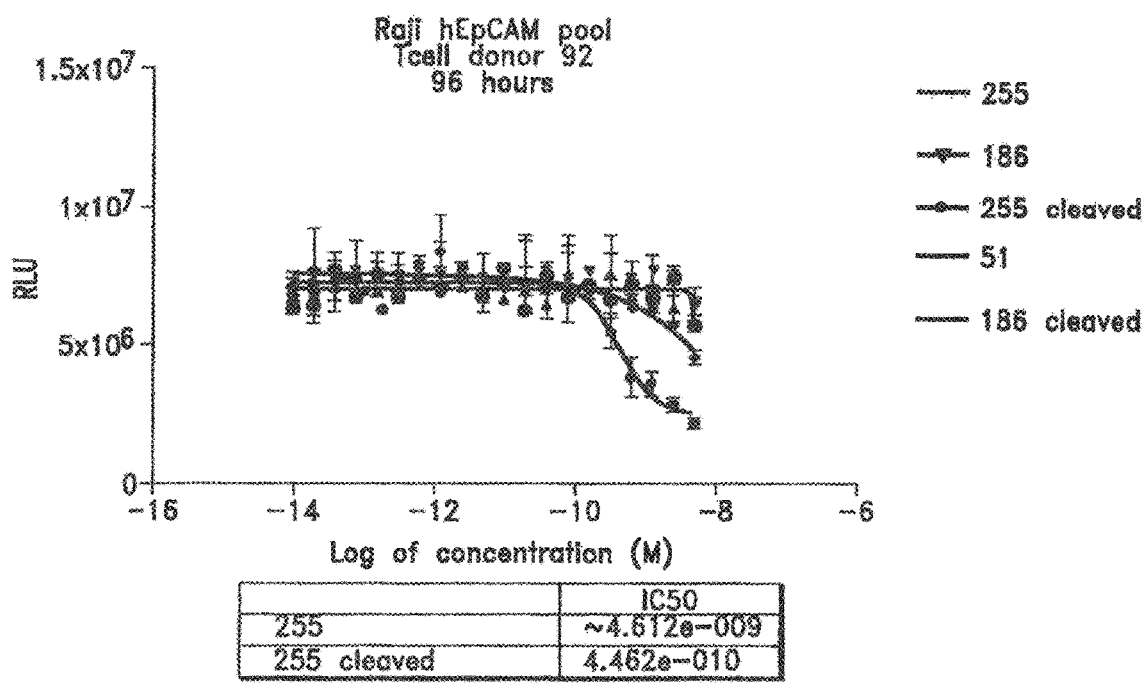
Figure 57C:
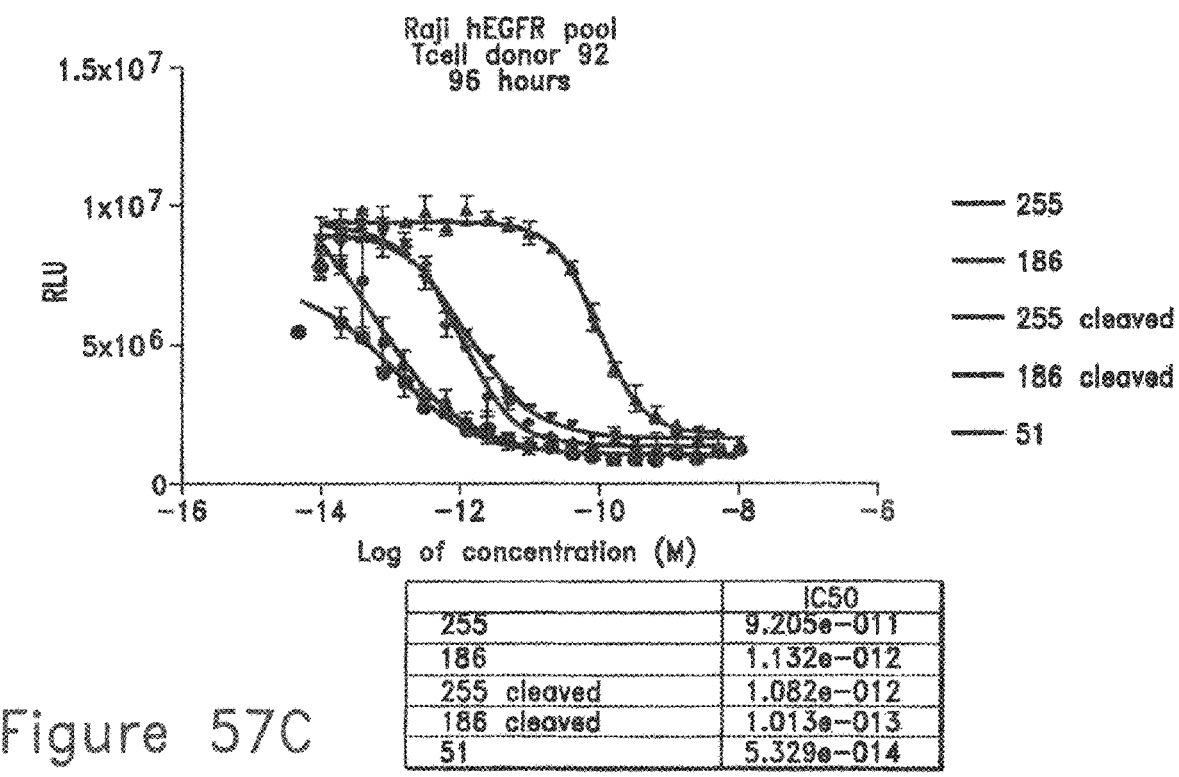
Figure 57D:
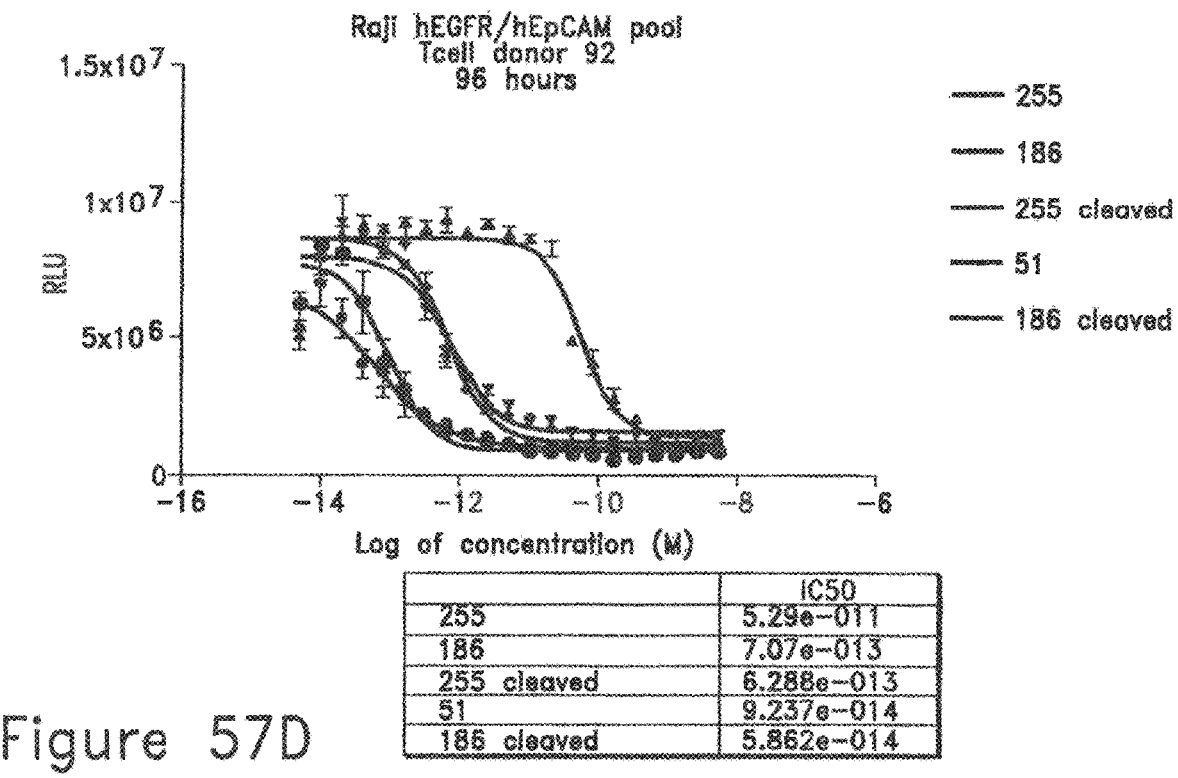
Figure 58:
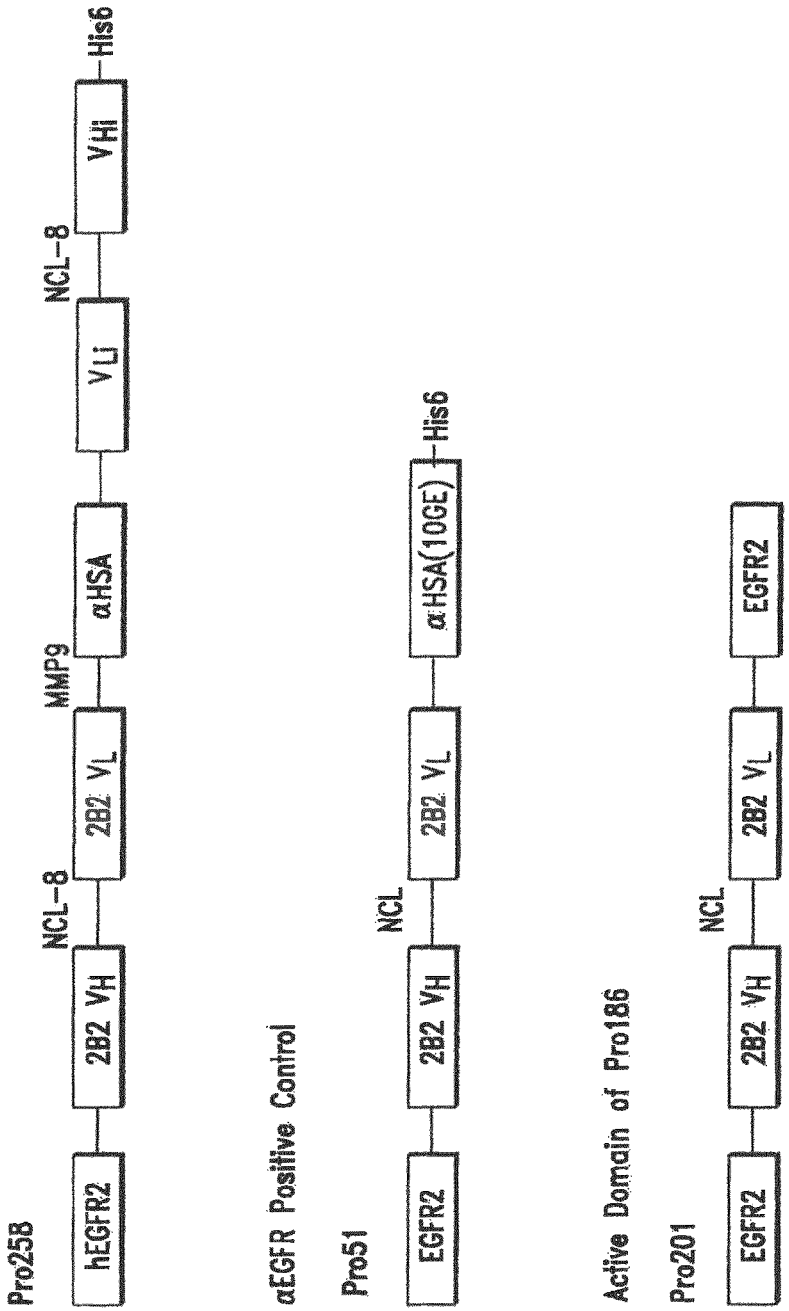
FIG. 58 depicts the schematics of a Format 4 construct, Pro258.
Figure 59A:
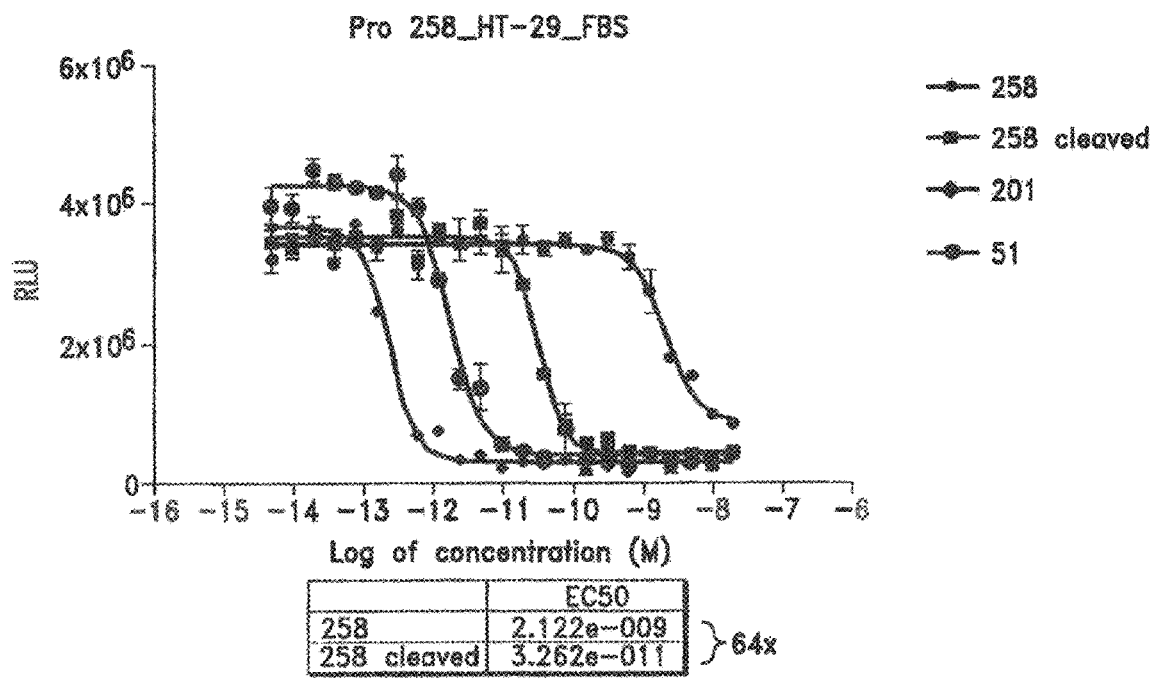
FIG. 59A-FIG. 59B shows that Pro258 is conditional in both FBS and human serum. The conditionality of the MMP9 linker is underestimated due to the MMP9 activity in the culture. Interestingly, Pro51 TDCC activity is inhibited by HSA binding while Pro258 TDCC activity is similar to Pro51 in the presence of HSA. Finally, the Pro258 conditionality is somewhat enhanced in the presence of HSA by 6×.
Figure 59B:
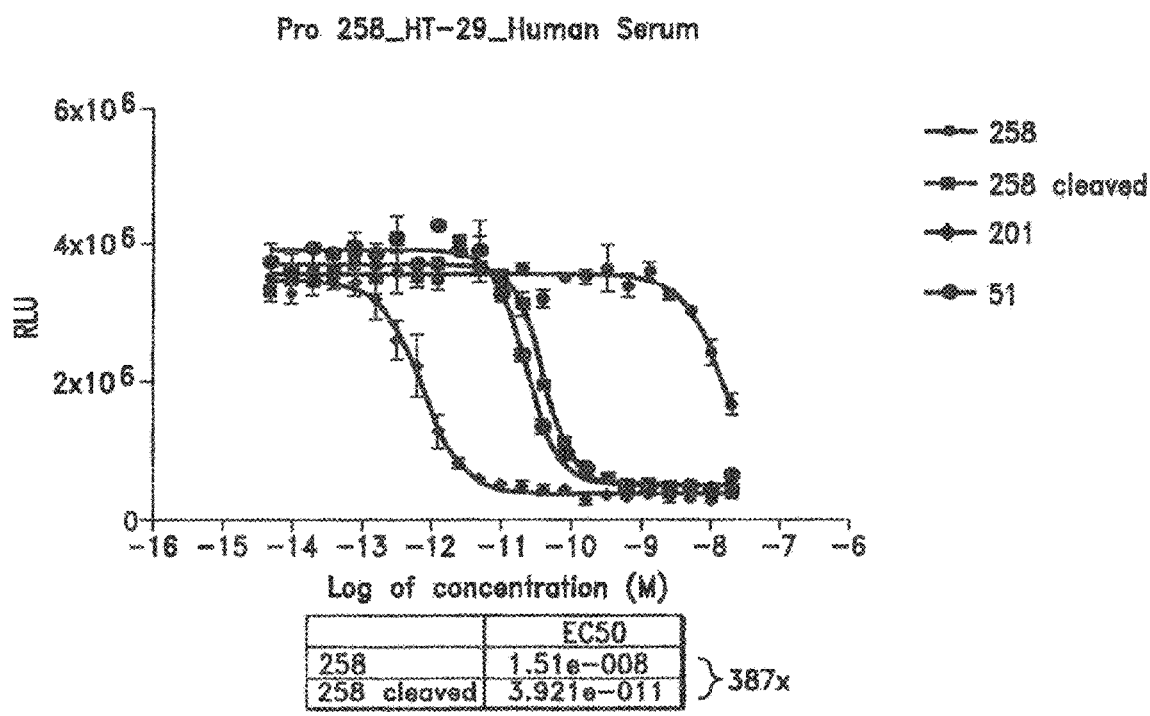

Interestingly, for ease of description, while these constructs are all referred to herein as "constrained", additional work shows that the intramolecular assembly is favored even if one of the Fv domains is not constrained, e.g. one of the domains can have a longer, flexible linker. That is, as shown in the FIGS. 37-39, intramolecular assembly still occurs (e.g. the uncleaved constructs are inactive in the absence of protease cleavage) if only one of the Fv domains, either the one with an active VL and VH, or the pseudo Fv domain, is constrained. However, in the current systems, when both linkers are constrained, the protein has better expression. However, as will be appreciated by those of skill in the art, any of the Format 1, Format 2 or Format 4 constructs herein can have one of these Fv domains with an "unconstrained" or "flexible" linker. For ease of reference, the constructs are shown with both Fv domains in a constrained format.

The constructs and formats of the invention are variations over inventions described in WO2017/156178, hereby expressly incorporated by reference in its entirety. As shown in FIGS. 17-21, previous constructs have the ability to isomerize due to the presence of two sets of VH and VL domains in a single polypeptide, forming both a bivalent scFv and a single chain diabody. Even after purification of each isoform, the bivalent construct can still reach equilibrium with the diabody isoform. As the single chain diabody has the ability to bind to CD3 in the absence of protease cleavage, the utility of the construct is diminished.

Figure 1:
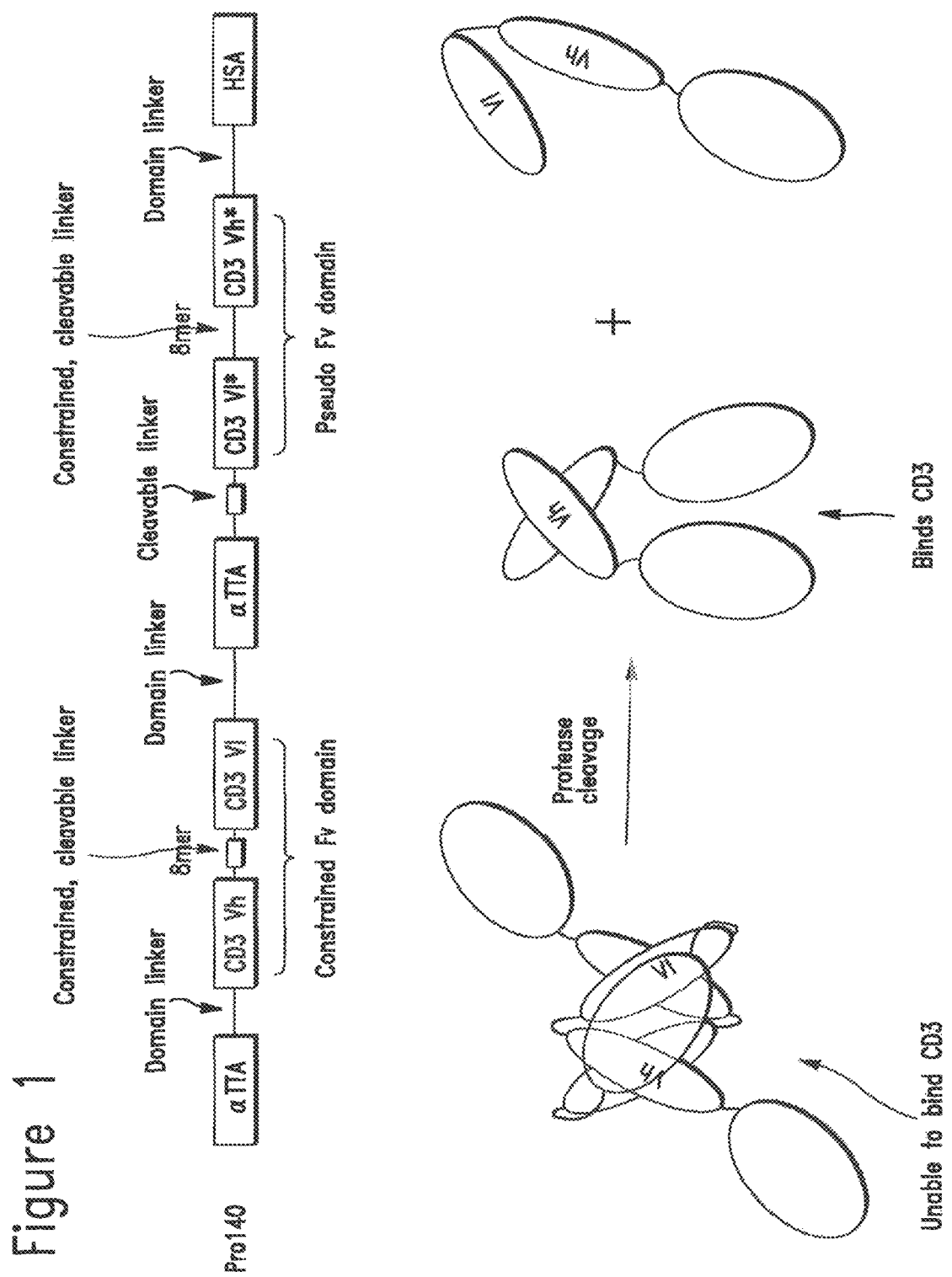
FIG. 1 depicts the "format 1" type of protease activation of the present invention, referred to herein as "constrained, cleavable constructs" or "cc constructs". In this embodiment, a representative construct is Pro140: there are ABDs for two TTA (as depicted in FIG. 1, these are both the same, although as described herein they can be different). Upon cleavage, the prodrug construct splits into three components, one containing an α-TTA domain linked via a domain linker to an active VH of aCD3, the second containing an α-TTA domain linked via a domain linker to an active VL of aCD3, and a "leftover" piece comprising the half-life extension domain linked to the inactive VH and VL. The two active variable domains then are free to associate to form a functional anti-CD3 binding domain. It should be noted that in "format 1" embodiments, the resulting active component is trivalent: there is monovalent binding to CD3 and bivalent binding to the TTA, rendering a bispecific binding protein, although in some cases this trivalency could be trispecifics, with monovalent binding to CD3, monovalent binding to a first TTA and monovalent binding to a second TTA.

To solve this issue, the present invention provides for four separate types of constructs to accomplish this conditional activation. The prodrug activation can happen in one of four general ways, as is generally shown in the Figures. In FIG. 1, a "format 1" mechanism is shown. In this embodiment, the prodrug construct has two cleavage sites: one between the VH and vl domains of the constrained Fv, thus freeing the two variable domains to associate, and a second at a site that releases the pseudo Fv domain from the prodrug construct, leaving two molecules that associate due to the innate self-assembly of the variable heavy and variable light domains, each having an antigen binding domain to a tumor antigen as well, thus allowing the recruitment of T cells to the tumor site.

Figure 2:
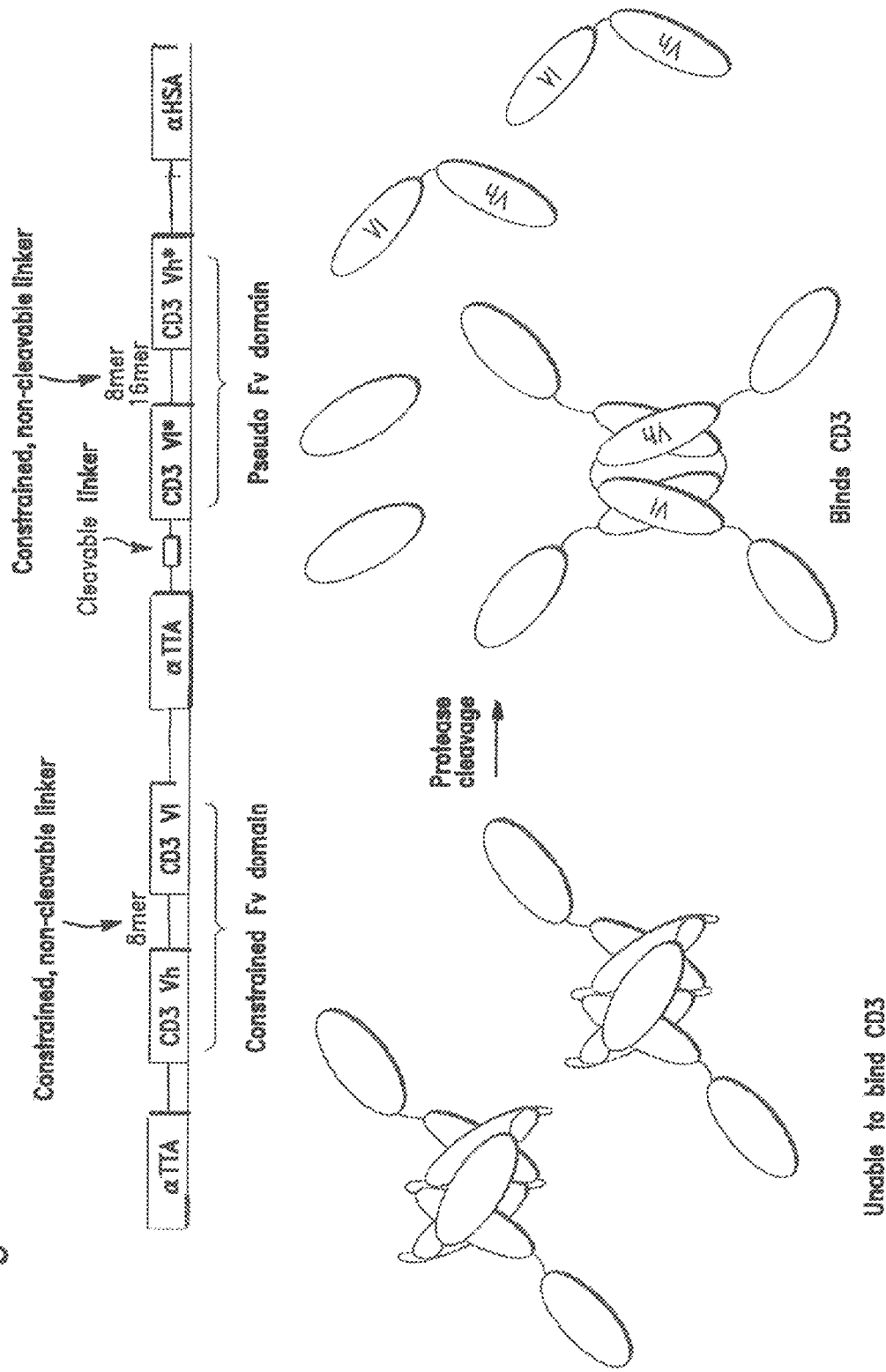
FIG. 2 depicts the "format 2" type of protease activation of the present invention, referred to herein as "constrained, non-cleavable constructs", or "CNCL constructs", also sometimes referred to herein as "dimerization constructs" as discussed herein. These constructs do not isomerize as discussed herein. Upon cleavage, two prodrug construct splits into four components, two half-life extension domains (in this case, sdABDs to HSA) linked to two pseudo domains (which may or may not be able to self-associate, depending on the length of the linkers and the inactivating mutations), and two active moieties that self-assemble into a dimeric active moiety that contains four anti-TTA domains (which can be all the same or two are the same and the other two are different). It should be noted that in "format 2" embodiments, the resulting active component is hexavalent: there is bivalent binding to CD3 and quadrivalent binding to the TTA, rendering a bispecific binding protein, although in some cases this hexavalency could be trispecifics, with bivalent binding to CD3, bivalent binding to a first TTA and bivalent binding to a second TTA.

In an alternate embodiment, the prodrug construct is shown in FIG. 2, a "format 2" mechanism. In this embodiment, the domain linker between the active variable heavy and active light chains is a constrained but not cleavable linker ("CNCL"). In the prodrug format, the inactive VH and VL of the constrained pseudo Fv domain associate with the VH and VL of the constrained Fv domain, such that there is no CD3 binding. However, once cleavage in the tumor environment happens, two different activated proteins, each comprising an active variable heavy and light domain, associate to form two anti-CD3 binding domains. This format 2 has two target tumor antigen binding domains ("TTA-ABDs") which as more fully described below, can either be identical (e.g. "homo-COBRAs"), or different (e.g. "hetero-COBRAs"). If different, they can each be directed to a different tumor antigen, or they can be directed to the same tumor antigen, but different epitopes, as is more fully described below.

In addition to the "single chain protein" COBRA formats discussed above, where all of the components are contained on a single amino acid sequence, there are also constructs that rely on two proteins "hemi-COBRAs", which act in pairs, as shown in FIG. 3. In this embodiment, each protein has one active and one inert variable domain separated by a protease cleavage site. Each molecule contains a TTA binding domain, such that when the molecules are bound to the TTA and exposed to tumor protease, the inert domains are cleaved off and the two active variable domains self-assemble to form an anti-CD3 binding domain.

Furthermore, the invention provides "format 4" constructs as well, as depicted in FIG. 4. These are similar to the "format 2" designs, except that a single ABD to a TTA is used, such that upon cleavage, two of the pro-drug molecules now form a tetravalent, bispecific construct containing two active anti-CD3 domains, as is further described below.

Accordingly, the formats and constructs of the invention find use in the treatment of disease.

Definitions

In order that the application may be more completely understood, several definitions are set forth below. Such definitions are meant to encompass grammatical equivalents.

By "amino acid" and "amino acid identity" as used herein is meant one of the 20 naturally occurring amino acids or any non-natural analogues that may be present at a specific, defined position. In many embodiments, "amino acid" means one of the 20 naturally occurring amino acids. By "protein" herein is meant at least two covalently attached amino acids, which includes proteins, polypeptides, oligopeptides and peptides.

By "amino acid modification" herein is meant an amino acid substitution, insertion, and/or deletion in a polypeptide sequence or an alteration to a moiety chemically linked to a protein. For example, a modification may be an altered carbohydrate or PEG structure attached to a protein. For clarity, unless otherwise noted, the amino acid modification is always to an amino acid coded for by DNA, e.g. the 20 amino acids that have codons in DNA and RNA. The preferred amino acid modification herein is a substitution.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence.

By "amino acid deletion" or "deletion" as used herein is meant the removal of an amino acid sequence at a particular position in a parent polypeptide sequence.

The polypeptides of the invention specifically bind to CD3 and target tumor antigens (TTAs) such as target cell receptors, as outlined herein. "Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore assay or Octet as is known in the art.

By "parent polypeptide" or "precursor polypeptide" (including Fc parent or precursors) as used herein is meant a polypeptide that is subsequently modified to generate a variant. Said parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent Fc polypeptide" as used herein is meant an unmodified Fc polypeptide that is modified to generate a variant, and by "parent antibody" as used herein is meant an unmodified antibody that is modified to generate a variant antibody.

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. A target antigen may be a protein, carbohydrate, lipid, or other chemical compound. A range of suitable exemplary target antigens are described herein.

By "target cell" as used herein is meant a cell that expresses a target antigen. Generally, for the purposes of the invention, target cells are either tumor cells that express TTAs or T cells that express the CD3 antigen.

By "Fv" or "Fv domain" or "Fv region" as used herein is meant a polypeptide that comprises the VL and VH domains of an antigen binding domain, generally from an antibody. Fv domains usually form an "antigen binding domain" or "ABD" as discussed herein, if they contain active VH and VL domains (although in some cases, an Fv containing a constrained linker is used, such that an active ABD isn't formed prior to cleavage). As discussed below, Fv domains can be organized in a number of ways in the present invention, and can be "active" or "inactive", such as in a scFv format, a constrained Fv format, a pseudo Fv format, etc. It should be understood that in the present invention, in some cases an Fv domain is made up of a VH and VL domain on a single polypeptide chain, such as shown in FIG. 1 and FIG. 2 but with a constrained linker such that an intramolecular ABD cannot be formed. In these embodiments, it is after cleavage that two active ABDs are formed. In some cases an Fv domain is made up of a VH and a VL domain, one of which is inert, such that only after cleavage is an intermolecular ABD formed. As discussed below, Fv domains can be organized in a number of ways in the present invention, and can be "active" or "inactive", such as in a scFv format, a constrained Fv format, a pseudo Fv format, etc. In addition, as discussed herein, Fv domains containing VH and VL can be/form ABDs, and other ABDs that do not contain VH and VL domains can be formed using sdABDs.

By "variable domain" herein is meant the region of an immunoglobulin that comprises one or more Ig domains substantially encoded by any of the Vκ, Vλ, and/or VH genes that make up the kappa, lambda, and heavy chain immunoglobulin genetic loci respectively. In some cases, a single variable domain, such as a sdFv (also referred to herein as sdABD) can be used.

In embodiments utilizing both variable heavy (VH) and variable light (VL) domains, each VH and VL is composed of three hypervariable regions ("complementary determining regions," "CDRs") and four "framework regions", or "FRs", arranged from amino-terminus to carboxy-terminus in the following order: FR1-CDR1-FR2-CDR2-FR3-CDR3-FR4. Thus, the VH domain has the structure vhFR1-vhCDR1-vhFR2-vhCDR2-vhFR3-vhCDR3-vhFR4 and the VL domain has the structure vlFR1-vlCDR1-vlFR2-vlCDR2-vlFR3-vlCDR3-vlFR4. As is more fully described herein, the vhFR regions and the vlFR regions self assemble to form Fv domains. In general, in the prodrug formats of the invention, there are "constrained Fv domains" wherein the VH and VL domains cannot self associate, and "pseudo Fv domains" for which the CDRs do not form antigen binding domains when self associated.

The hypervariable regions confer antigen binding specificity and generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3).

A useful comparison of CDR numbering is as below, see Lafranc et al., Dev. Comp. Immunol. 27(1):55-77 (2003):

TABLE 1

| | Kabat + Chothia | IMGT | Kabat | AbM | Chothia | Contact |
|---|---|---|---|---|---|---|
| vhCDR1 | 26-35 | 27-38 | 31-35 | 26-35 | 26-32 | 30-35 |
| vhCDR2 | 50-65 | 56-65 | 50-65 | 50-58 | 52-56 | 47-58 |
| vhCDR3 | 95-102 | 105-117 | 95-102 | 95-102 | 95-102 | 93-101 |
| vlCDR1 | 24-34 | 27-38 | 24-34 | 24-34 | 24-34 | 30-36 |
| vlCDR2 | 50-56 | 56-65 | 50-56 | 50-56 | 50-56 | 46-55 |
| vlCDR3 | 89-97 | 105-117 | 89-97 | 89-97 | 89-97 | 89-96 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" in the context of the anti-CD3 component comprises the three variable light and three variable heavy CDRs, e.g. a vlCDR1, vlCDR2, vlCDR3, vhCDR1, vhCDR2 and vhCDR3. As will be appreciated by those in the art, each set of CDRs, the VH and VL CDRs, can bind to antigens, both individually and as a set. For example, in constrained Fv domains, the vhCDRs can bind, for example to CD3 and the vhCDRs can bind to CD3, but in the constrained format they cannot bind to CD3.

In the context of a single domain ABD ("sdABD") such as are generally used herein to bind to target tumor antigens (TTA), a CDR set is only three CDRs; these are sometimes referred to in the art as "VHH" domains as well.

These CDRs can be part of a larger variable light or variable heavy domain, respectfully. In addition, as more fully outlined herein, the variable heavy and variable light domains can be on separate polypeptide chains or on a single polypeptide chain in the case of scFv sequences, depending on the format and configuration of the moieties herein.

The CDRs contribute to the formation of the antigen-binding, or more specifically, epitope binding sites. "Epitope" refers to a determinant that interacts with a specific antigen binding site in the variable regions known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specific antigen binding peptide; in other words, the amino acid residue is within the footprint of the specific antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The variable heavy and variable light domains of the invention can be "active" or "inactive".

As used herein, "inactive VH" ("iVH") and "inactive VL" ("iVL") refer to components of a pseudo Fv domain, which, when paired with their cognate VL or VH partners, respectively, form a resulting VH/VL pair that does not specifically bind to the antigen to which the "active" VH or "active" VL would bind were it bound to an analogous VL or VH, which was not "inactive". Exemplary "inactive VH" and "inactive VL" domains are formed by mutation of a wild type VH or VL sequence as more fully outlined below. Exemplary mutations are within CDR1, CDR2 or CDR3 of VH or VL. An exemplary mutation includes placing a domain linker within CDR2, thereby forming an "inactive VH" or "inactive VL" domain. In contrast, an "active VH" or "active VL" is one that, upon pairing with its "active" cognate partner, i.e., VL or VH, respectively, is capable of specifically binding to its target antigen. Thus, it should be understood that a pseudo Fv can be a VH/iVL pair, a iVH/VL pair, or a iVH/iVL pair.

In contrast, as used herein, the term "active" refers to a CD-3 binding domain that is capable of specifically binding to CD-3. This term is used in two contexts: (a) when referring to a single member of an Fv binding pair (i.e., VH or VL), which is of a sequence capable of pairing with its cognate partner and specifically binding to CD-3; and (b) the pair of cognates (i.e., VH and VL) of a sequence capable of specifically binding to CD-3. An exemplary "active" VH, VL or VH/VL pair is a wild type or parent sequence.

"CD-x" refers to a cluster of differentiation (CD) protein. In exemplary embodiments, CD-x is selected from those CD proteins having a role in the recruitment or activation of T-cells in a subject to whom a polypeptide construct of the invention has been administered. In an exemplary embodiment, CD-x is CD3, the sequence of which is shown in FIG. 5.

The term "binding domain" characterizes, in connection with the present invention, a domain which (specifically) binds to/interacts with/recognizes a given target epitope or a given target site on the target molecules (antigens), for example: EGFR and CD-3, respectively. The structure and function of the target antigen binding domain (recognizing EGFR), and preferably also the structure and/or function of the CD-3 binding domain (recognizing CD3), is/are based on the structure and/or function of an antibody, e.g. of a full-length or whole immunoglobulin molecule, including sdABDs. According to the invention, the target antigen binding domain is generally characterized by the presence of three CDRs that bind the target tumor antigen (generally referred to in the art as variable heavy domains, although no corresponding light chain CDRs are present). Alternatively, ABDs to TTAs can include three light chain CDRs (i.e. CDR1, CDR2 and CDR3 of the VL region) and/or three heavy chain CDRs (i.e. CDR1, CDR2 and CDR3 of the VH region). The CD-3 binding domain preferably also comprises at least the minimum structural requirements of an antibody which allow for the target binding. More preferably, the CD-3 binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that in exemplary embodiments the target antigen and/or CD-3 binding domain is produced by or obtainable by phage-display or library screening methods.

By "domain" as used herein is meant a protein sequence with a function, as outlined herein. Domains of the invention include tumor target antigen binding domains (TTA domains), variable heavy domains, variable light domains, scFv domains, linker domains, and half life extension domains.

By "domain linker" herein is meant an amino acid sequence that joins two domains as outlined herein. Domain linkers can be cleavable linkers, constrained cleavable linkers, non-cleavable linkers, constrained non-cleavable linkers, scFv linkers, etc.

By "cleavable linker" ("CL") herein is meant an amino acid sequence that can be cleaved by a protease, preferably a human protease in a disease tissue as outlined herein. Cleavable linkers generally are at least 3 amino acids in length, with from 4, 5, 6, 7, 8, 9, 10, 11, 12, 13, 14, 15 or more amino acids finding use in the invention, depending on the required flexibility. A number of cleavable linker sequences are found in FIG. 6 and FIG. 5.

By "non cleavable linker" ("NCL") herein is meant an amino acid sequence that cannot be cleaved by a human protease under normal physiological conditions.

By "constrained cleavable linker" ("CCL") herein is meant a short polypeptide that contains a protease cleavage site (as defined herein) that joins two domains as outlined herein in such a manner that the two domains cannot significantly interact with each other until after they reside on different polypeptide chains, e.g. after cleavage. When the CCL joins a VH and a VL domain as defined herein, the VH and VL cannot self-assemble to form a functional Fv prior to cleavage due to steric constraints in an intramolecular way (although they may assemble into pseudo Fv domains in an intermolecular way). Upon cleavage by the relevant protease, the VH and VL can assemble to form an active antigen binding domain in an intermolecular way. In general, CCLs are less than 10 amino acids in length, with 9, 8, 7, 6, 5 and 4 amino acids finding use in the invention. In general, protease cleavage sites generally are at least 4+ amino acids in length to confer sufficient specificity, as is shown in FIG. 6.

By "constrained non-cleavable linker" ("CNCL") herein is meant a short polypeptide that that joins two domains as outlined herein in such a manner that the two domains cannot significantly interact with each other, and that is not significantly cleaved by human proteases under physiological conditions.

By "constrained Fv domain" herein is meant an Fv domain that comprises an active variable heavy domain and an active variable light domain, linked covalently with a constrained linker as outlined herein, in such a way that the active heavy and light variable domains cannot intramolecularly interact to form an active Fv that will bind an antigen such as CD3. Thus, a constrained Fv domain is one that is similar to an scFv but is not able to bind an antigen due to the presence of a constrained linker (although they may assemble intermolecularly with inert variable domains to form pseudo Fv domains).

By "pseudo Fv domain" herein is meant a domain that comprises a pseudo or inactive variable heavy domain or a pseudo or inactive variable light domain, or both, linked using a domain linker (which can be cleavable, constrained, non-cleavable, non-constrained, etc.). The iVH and iVL domains of a pseudo Fv domain do not bind to a human antigen when either associated with each other (iVH/iVL) or when associated with an active VH or VL; thus iVH/iVL, iVH/VL and iVL/VH Fv domains do not appreciably bind to a human protein, such that these domains are inert in the human body.

By "single chain Fv" or "scFv" herein is meant a variable heavy (VH) domain covalently attached to a variable light (VL) domain, generally using a domain linker as discussed herein, to form a scFv or scFv domain. A scFv domain can be in either orientation from N- to C-terminus (VH-linker-VL or VL-linker-VH).

By "single domain Fv", "sdFv" or "sdABD" herein is meant an antigen binding domain that only has three CDRs, generally based on camelid antibody technology. See: Protein Engineering 9(7):1129-35 (1994); Rev Mol Biotech 74:277-302 (2001); Ann Rev Biochem 82:775-97 (2013). As outlined herein, there are two general types of sdABDs used herein: sdABDs that bind to TTAs, and are annotated as such (sdABD-TTA for the generic term, or sdABD-EGFR for one that binds to EGFR, sdABD-FOLR1 for one that binds to FOLR1, etc.) and sdABDs that bind to HSA ("sdABD-HSA" or "sdABD(½)".

By "protease cleavage site" refers to the amino acid sequence recognized and cleaved by a protease. Suitable protease cleavage sites are outlined below and shown in FIG. 5 and FIG. 6.

As used herein, "protease cleavage domain" refers to the peptide sequence incorporating the "protease cleavage site" and any linkers between individual protease cleavage sites and between the protease cleavage site(s) and the other functional components of the constructs of the invention (e.g., VH, VL, iVH, iVL, target antigen binding domain(s), half-life extension domain, etc.). As outlined herein, a protease cleavage domain may also include additional amino acids if necessary, for example to confer flexibility.

The term "COBRA™" and "conditional bispecific redirected activation" refers to a bispecific conditionally effective protein that has a number of functional protein domains. In some embodiments, one of the functional domains is an antigen binding domain (ABD) that binds a target tumor antigen (TTA). In certain embodiments, another domain is an ABD that binds to a T cell antigen under certain conditions. The T cell antigen includes but is not limited to CD3. The term "hemi-COBRA™" refers to a conditionally effective protein that can bind a T cell antigen when a variable heavy chain of a hemi-COBRA can associate to a variable light chain of another hemi-COBRA™ (a complementary hemi-COBRA™) due to innate self-assembly when concentrated on the surface of a target expressing cell.

DETAILED DESCRIPTION OF THE EMBODIMENTS

I. Fusion Proteins of the Invention

The fusion proteins of the invention have a number of different components, generally referred to herein as domains, that are linked together in a variety of ways. Some of the domains are binding domains, that each bind to a target antigen (e.g. a TTA or CD3, for example). As they bind to more than one antigen, they are referred to herein as "multispecific"; for example, a prodrug construct of the invention may bind to a TTA and CD3, and thus are "bispecific". A protein can also have higher specificities; for example, if the first aTTA binds to EGFR, the second to EpCAM and there is an anti-CD3 binding domain, this would be a "trispecific" molecule. Similarly, the addition of an anti-HSA binding domain to this construct would be "tetraspecific", as shown in FIG. 3B.

As will be appreciated by those in the art, the proteins of the invention can have different valencies as well as be multispecific. That is, proteins of the invention can bind a target with more than one binding site; for example, Pro140 is bivalent for EGFR.

The proteins of the invention can include CD3 antigen binding domains arranged in a variety of ways as outlined herein, tumor target antigen binding domains, half-life extension domains, linkers, etc.

A. CD3 Antigen Binding Domains

The specificity of the response of T cells is mediated by the recognition of antigen (displayed in context of a major histocompatibility complex, MHC) by the T cell receptor complex. As part of the T cell receptor complex, CD3 is a protein complex that includes a CD3γ (gamma) chain, a CD3δ (delta) chain, two CD3ε (epsilon) chains and two CD3ζ (zeta) chains, which are present at the cell surface. CD3 molecules associate with the α (alpha) and β (beta) chains of the T cell receptor (TCR) to comprise the TCR complex. Clustering of CD3 on T cells, such as by Fv domains that bind to CD3 leads to T cell activation similar to the engagement of the T cell receptor but independent of its clonal-typical specificity.

However, as is known in the art, CD3 activation can cause a number of toxic side effects, and accordingly the present invention is directed to providing active CD3 binding of the polypeptides of the invention only in the presence of tumor cells, where specific proteases are found, that then cleave the prodrug polypeptides of the invention to provide an active CD3 binding domain. Thus, in the present invention, binding of an anti-CD-3 Fv domain to CD-3 is regulated by a protease cleavage domain which restricts binding of the CD-3 Fv domain to CD-3 only in the microenvironment of a diseased cell or tissue with elevated levels of proteases, for example in a tumor microenvironment as is described herein.

Accordingly, the present invention provides two sets of VH and VL domains, an active set (VH and VL) and an inactive set (iVH and iVL) with all four being present in the prodrug construct. The construct is formatted such that the VH and VL set cannot self-associate, but rather associates with an inactive partner, e.g. iVH and VL and iVL and VH as is shown herein.

1. Active Anti-CD3 Variable Heavy and Variable Light Domains

There are a number of suitable active CDR sets, and/or VH and VL domains, that are known in the art that find use in the present invention. For example, the CDRs and/or VH and VL domains are derived from known anti-CD-3 antibodies, such as, for example, muromonab-CD-3 (OKT3), otelixizumab (TRX4), teplizumab (MGA031), visilizumab (Nuvion), SP34 or I2C, TR-66 or X35-3, VIT3, BMA030 (BW264/56), CLB-T3/3, CRIS7, YTH12.5, F111-409, CLB-T3.4.2, TR-66, WT32, SPv-T3b, 11D8, XIII-141, XIII-46, XIII-87, 12F6, T3/RW2-8C8, T3/RW2-4B6, OKT3D, M-T301, SMC2, F101.01, UCHT-1 and WT-31.

In one embodiment, the VH and VL sequences that form an active Fv domain that binds to human CD3 are shown in FIG. 5. As is shown herein, these active VH ("aVH") and active VL ("aVL") domains can be used in different configurations and Formats 1, 2, 3 and 4.

2. Inactive Anti-CD3 Variable Heavy and Variable Light Domains

The inactive iVH and iVL domains contain "regular" framework regions (FRs) that allow association, such that an inactive variable domain will associate with an active variable domain, rendering the pair inactive, e.g. unable to bind CD3.

As will be appreciated by those in the art, there are a number of "inactive" variable domains that find use in the invention. Basically, any variable domain with human framework regions that allows self-assembly with another variable domain, no matter what amino acids are in the CDR location in the variable region, can be used. For clarity, the inactive domains are said to include CDRs, although technically the inactive variable domains do not confer binding capabilities.

As will be appreciated in the art, it is generally straightforward to generate inactive VH or VL domains, and can be done in a variety of ways. In some embodiments, the generation of inactive variable domains is generally done by altering one or more of the CDRs of an active Fv, including making changes in one or more of the three CDRs of an active variable domain. This can be done by making one or more amino acid substitutions at functionally important residues in one or more CDRs, replacing some or all CDR residues with random sequences, replacing one or more CDRs with tag or flag sequences, and/or swapping CDRs and/or variable regions with those from an irrelevant antibody (one directed to a different organism's protein for example.

In some cases, only one of the CDRs in a variable region can be altered to render it inactive, although other embodiments include alterations in one, two, three, four, five or six CDRs.

In some cases, the inactive domains can be engineered to promote selective binding in the prodrug format, to encourage formation of intramolecular iVH-VL and VH-iVL domains prior to cleavage (over, for example, intermolecular pair formation). See for example Igawa et al., Protein Eng. Des. Selection 23(8):667-677 (2010), hereby expressly incorporated by reference in its entirety and specifically for the interface residue amino acid substitutions.

In certain embodiments, the CD-3 binding domain of the polypeptide constructs described herein exhibit not only potent CD-3 binding affinities with human CD-3, but show also excellent cross reactivity with the respective cynomolgus monkey CD-3 proteins. In some instances, the CD-3 binding domain of the polypeptide constructs is crossreactive with CD-3 from cynomolgus monkey. In certain instances, human:cynomolgous KD ratios for CD-3 are between 5 and 0.2.

In some embodiments, the CD-3 binding domain of the antigen binding protein can be any domain that binds to CD-3 including but not limited to domains from a monoclonal antibody, a polyclonal antibody, a recombinant antibody, a human antibody, a humanized antibody. In some instances, it is beneficial for the CD-3 binding domain to be derived from the same species in which the antigen binding protein will ultimately be used in. For example, for use in humans, it may be beneficial for the CD-3 binding domain of the antigen binding protein to comprise human or humanized residues from the antigen binding domain of an antibody or antibody fragment.

Thus, in one aspect, the antigen-binding domain comprises a humanized or human binding domain. In one embodiment, the humanized or human anti-CD-3 binding domain comprises one or more (e.g., all three) light chain complementary determining region 1 (LC CDR1), light chain complementary determining region 2 (LC CDR2), and light chain complementary determining region 3 (LC CDR3) of a humanized or human anti-CD-3 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized or human anti-CD-3 binding domain described herein, e.g., a humanized or human anti-CD-3 binding domain comprising one or more, e.g., all three, LC CDRs and one or more, e.g., all three, HC CDRs.

In some embodiments, the humanized or human anti-CD-3 binding domain comprises a humanized or human light chain variable region specific to CD-3 where the light chain variable region specific to CD-3 comprises human or non-human light chain CDRs in a human light chain framework region. In certain instances, the light chain framework region is a λ (lambda) light chain framework. In other instances, the light chain framework region is a κ (kappa) light chain framework.

In some embodiments, one or more CD-3 binding domains are humanized or fully human. In some embodiments, one or more activated CD-3 binding domains have a KD binding of 1000 nM or less to CD-3 on CD-3 expressing cells. In some embodiments, one or more activated CD-3 binding domains have a KD binding of 100 nM or less to CD-3 on CD-3 expressing cells. In some embodiments, one or more activated CD-3 binding domains have a KD binding of 10 nM or less to CD-3 on CD-3 expressing cells. In some embodiments, one or more CD-3 binding domains have crossreactivity with cynomolgus CD-3. In some embodiments, one or more CD-3 binding domains comprise an amino acid sequence provided herein.

In some embodiments, the humanized or human anti-CD-3 binding domain comprises a humanized or human heavy chain variable region specific to CD-3 where the heavy chain variable region specific to CD-3 comprises human or non-human heavy chain CDRs in a human heavy chain framework region.

In one embodiment, the anti-CD-3 binding domain is an Fv comprising a light chain and a heavy chain of an amino acid sequence provided herein. In an embodiment, the anti-CD-3 binding domain comprises: a light chain variable region comprising an amino acid sequence having at least one, two or three modifications (e.g., substitutions) but not more than 30, 20 or 10 modifications (e.g., substitutions) of an amino acid sequence of a light chain variable region provided herein, or a sequence with 95-99% identity with an amino acid sequence provided herein; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided herein, or a sequence with 95-99% identity to an amino acid sequence provided herein. In one embodiment, the humanized or human anti-CD-3 binding domain is a scFv, and a light chain variable region comprising an amino acid sequence described herein, is attached to a heavy chain variable region comprising an amino acid sequence described herein, via a scFv linker. The light chain variable region and heavy chain variable region of a scFv can be, e.g., in any of the following orientations: light chain variable region-scFv linker-heavy chain variable region or heavy chain variable region-scFv linker-light chain variable region.

In some embodiments, CD-3 binding domain of an antigen binding protein has an affinity to CD-3 on CD-3 expressing cells with a KD of 1000 nM or less, 100 nM or less, 50 nM or less, 20 nM or less, 10 nM or less, 5 nM or less, 1 nM or less, or 0.5 nM or less. In some embodiments, the CD-3 binding domain of an antigen binding protein has an affinity to CD-3€ with a KD of 1000 nM or less, 100 nM or less, 50 nM or less, 20 nM or less, 10 nM or less, 5 nM or less, 1 nM or less, or 0.5 nM or less. In further embodiments, CD-3 binding domain of an antigen binding protein has low affinity to CD-3, i.e., about 100 nM or greater.

The affinity to bind to CD-3 can be determined, for example, by the ability of the antigen binding protein itself or its CD-3 binding domain to bind to CD-3 coated on an assay plate; displayed on a microbial cell surface; in solution; etc., as is known in the art, generally using Biacore or Octet assays. The binding activity of the antigen binding protein itself or its CD-3 binding domain of the present disclosure to CD-3 can be assayed by immobilizing the ligand (e.g., CD-3) or the antigen binding protein itself or its CD-3 binding domain, to a bead, substrate, cell, etc. Agents can be added in an appropriate buffer and the binding partners incubated for a period of time at a given temperature. After washes to remove unbound material, the bound protein can be released with, for example, SDS, buffers with a high pH, and the like and analyzed, for example, by Surface Plasmon Resonance (SPR).

In many embodiments, preferred active and inert binding domains are those shown in FIG. 5. FIG. 5 depicts one active VH and VL and three inactive VHi and three inactive VLis, that have been inactivated in different ways.

As shown in FIG. 5, a particularly useful pair of active anti-CD3 VL and VH domains has a VL with a vlCDR1 with SEQ ID NO:127, a vlCDR2 with SEQ ID NO:128 and a vlCDR3 with SEQ ID NO:129 and a VH with a vhCDR1 with SEQ ID NO:143, a vhCDR2 with SEQ ID NO:144 and a vhCDR3 with SEQ ID NO:145.

As shown in FIG. 5, a particularly useful pair of active anti-CD3 VL and VH domains has a VL with SEQ ID NO:126 and a VH with SEQ ID NO:142.

B. Antigen Binding Domains to Tumor Target Antigens

In addition to the described CD3 and half-life extension domains, the polypeptide constructs described herein also comprise target domains that bind to one or more target antigens or one or more regions on a single target antigen. It is contemplated herein that a polypeptide construct of the invention is cleaved, for example, in a disease-specific microenvironment or in the blood of a subject at the protease cleavage domain and that each target antigen binding domain will bind to a target antigen on a target cell, thereby activating the CD3 binding domain to bind a T cell. In general, the TTA binding domains can bind to their targets before protease cleavage, so they can "wait" on the target cell to be activated as T-cell engagers At least one target antigen is involved in and/or associated with a disease, disorder or condition. Exemplary target antigens include those associated with a proliferative disease, a tumorous disease, an inflammatory disease, an immunological disorder, an autoimmune disease, an infectious disease, a viral disease, an allergic reaction, a parasitic reaction, a graft-versus-host disease or a host-versus-graft disease. In some embodiments, a target antigen is a tumor antigen expressed on a tumor cell. Alternatively in some embodiments, a target antigen is associated with a pathogen such as a virus or bacterium. At least one target antigen may also be directed against healthy tissue.

In some embodiments, a target antigen is a cell surface molecule such as a protein, lipid or polysaccharide. In some embodiments, a target antigen is a on a tumor cell, virally infected cell, bacterially infected cell, damaged red blood cell, arterial plaque cell, or fibrotic tissue cell.

Preferred embodiments of the invention utilize sdABDs as the targeting domains. These are preferred over scFv ABDs, since the addition of other VH and VL domains into a construct of the invention may complicate the formation of pseudo Fv domains.

Figure 3A:
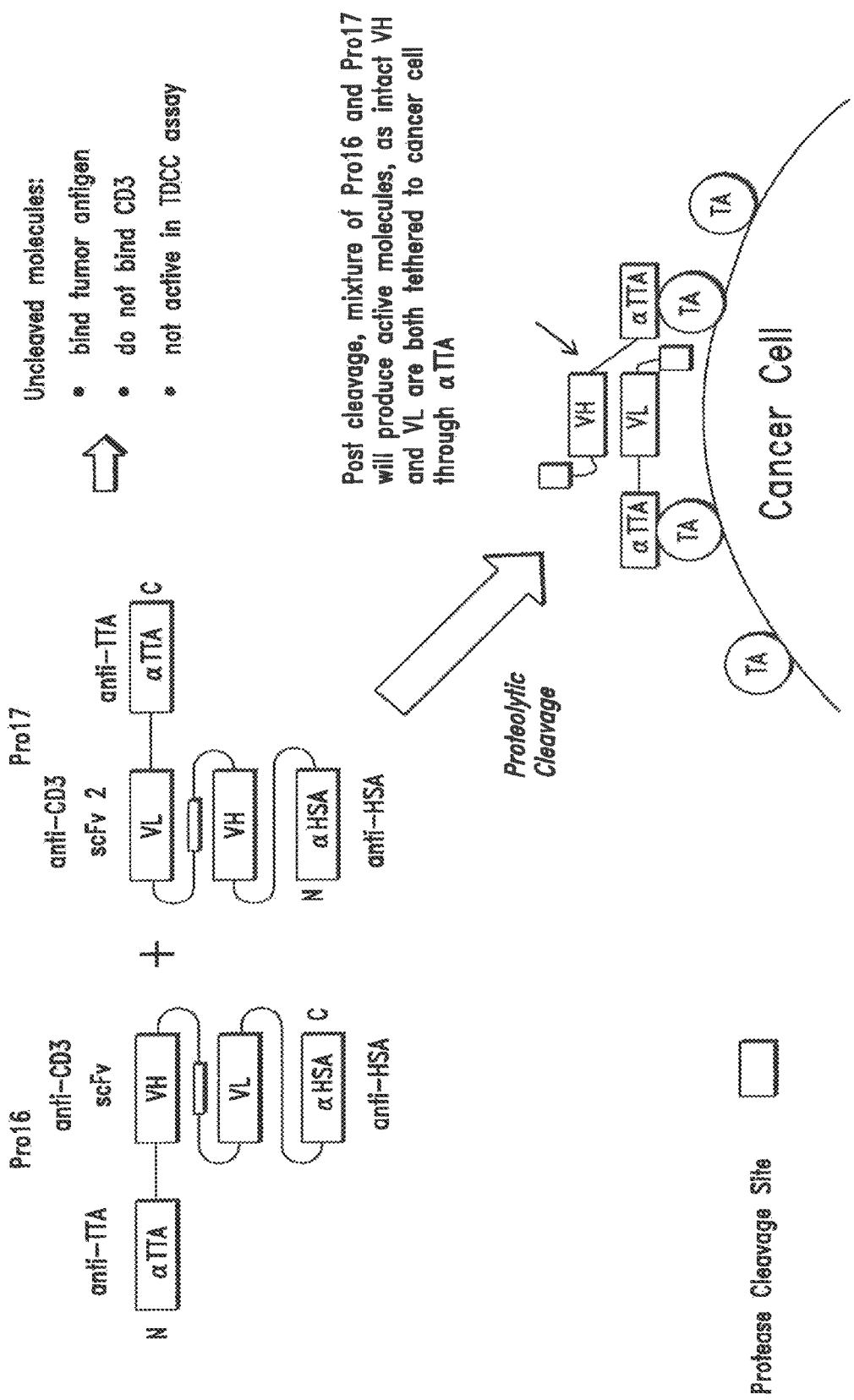
Figure 7A:
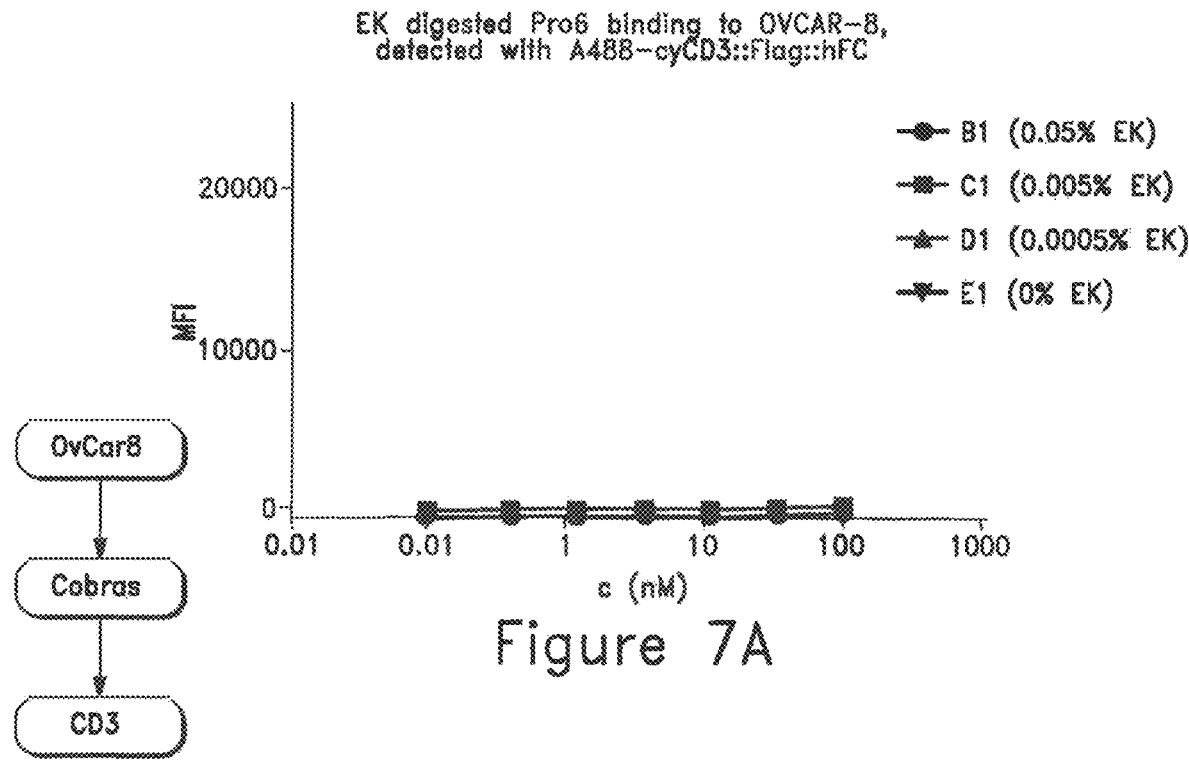
FIG. 7A-FIG. 7D depict some data associated with the "Format 3" or "hemi-COBRA™" structures. This shows that Format 3 constructs bind co-operatively to CD3 after cleavage by protease (in this case EK protease, although any of the protease cleavage sites outlined herein and depicted in FIG. 5 and FIG. 6 can be used) and create a CD3 binding site, as shown by a sandwich FACS analysis.
Figure 7B:
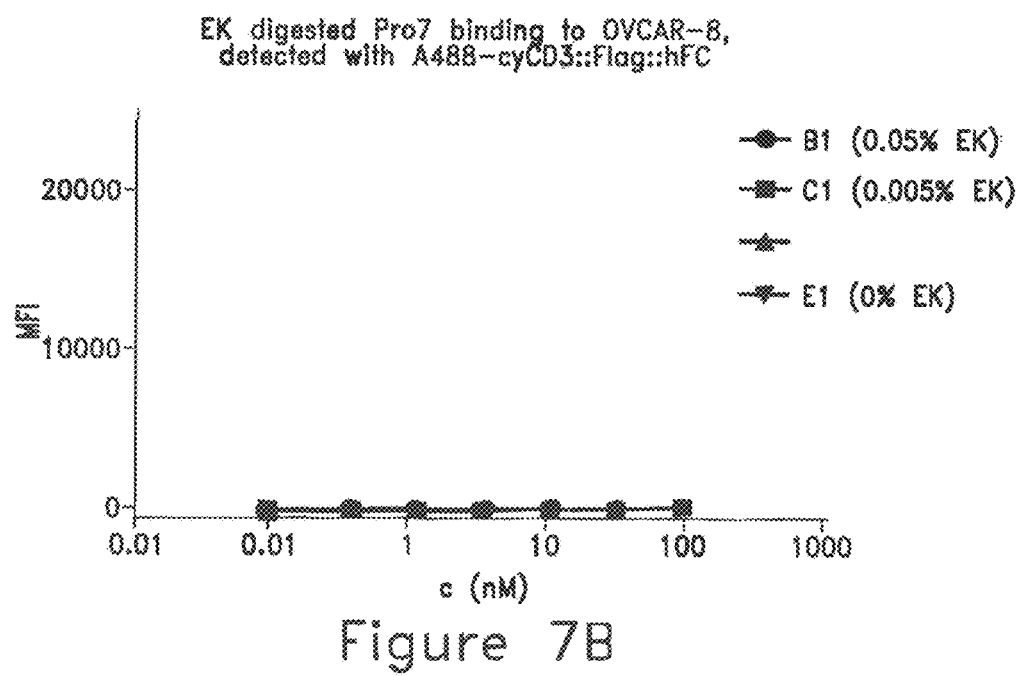
Figure 7C:
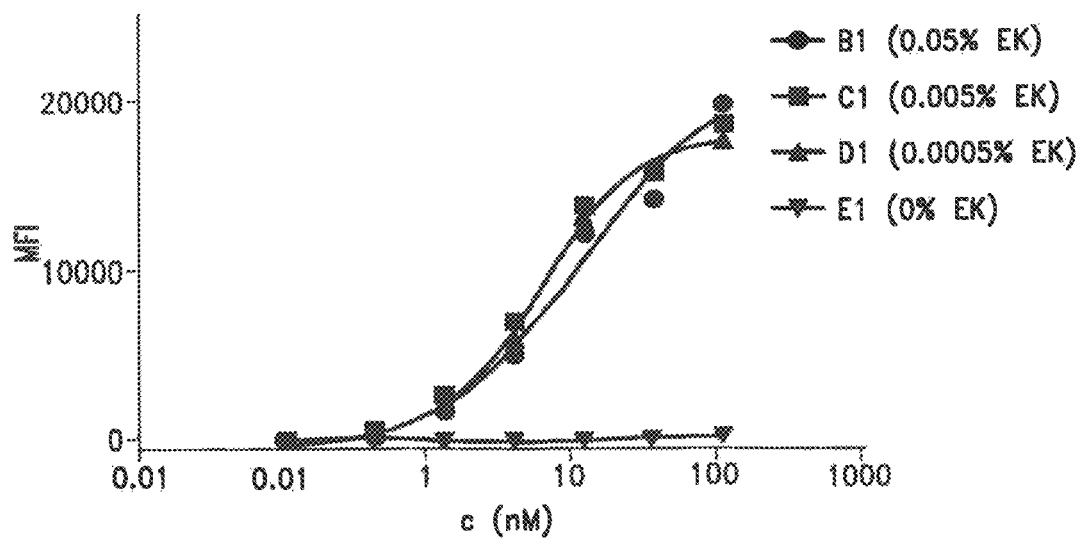
Figure 7D:
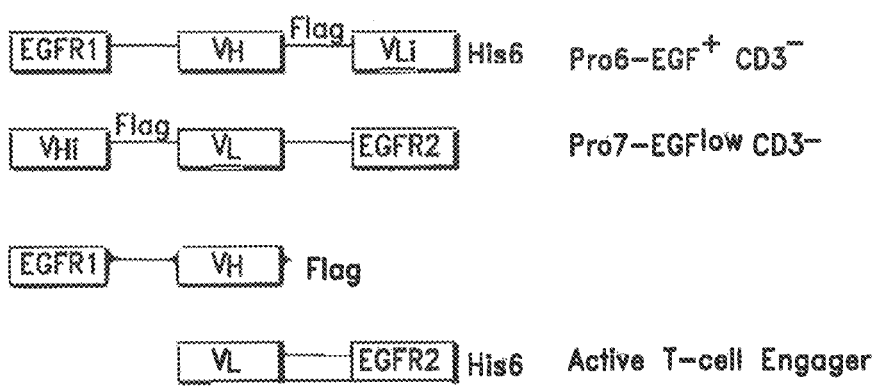
Figure 8A:
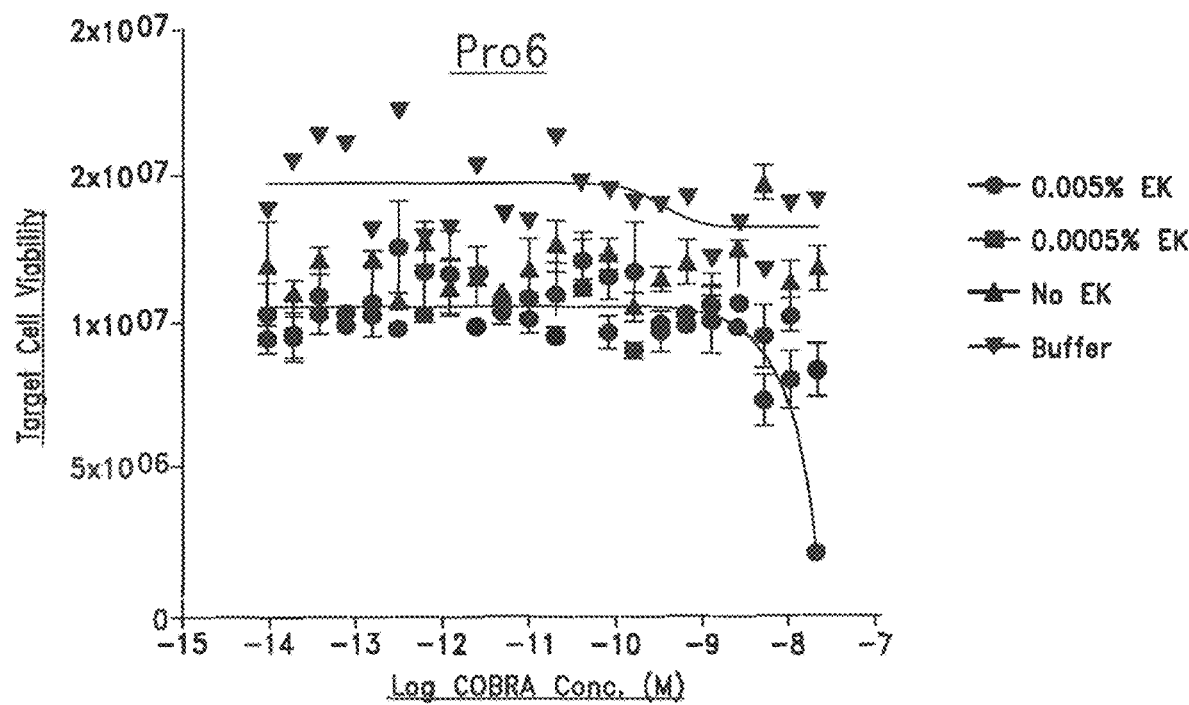
FIG. 8A-FIG. 8D shows that the protease cleavage co-operatively activates T-cell killing of EGFR+ target cells with complimentary hemi-COBRA™ pairs.
Figure 8B:
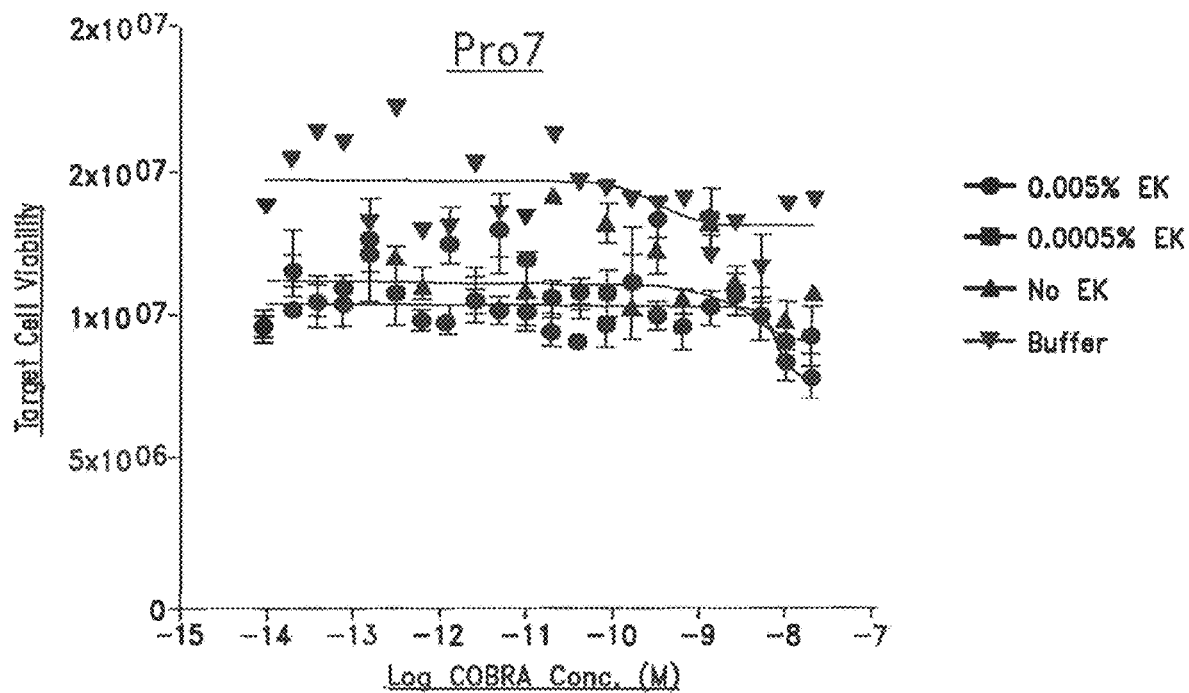
Figure 8C:
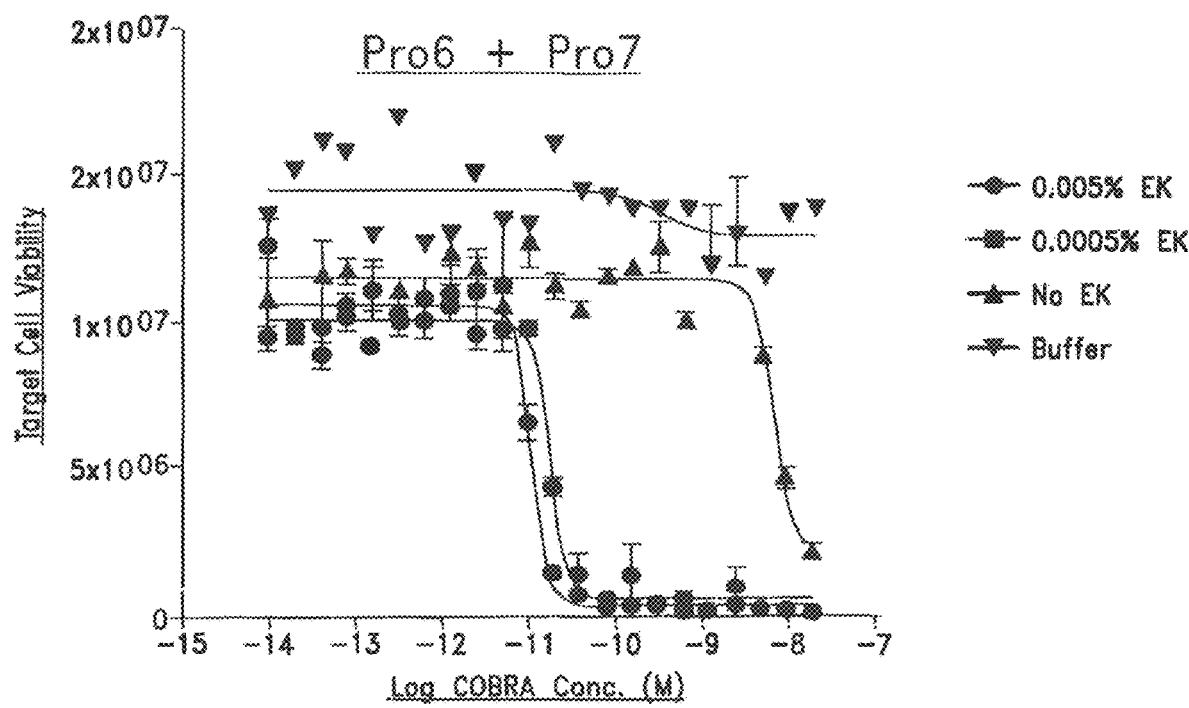
Figure 8D:
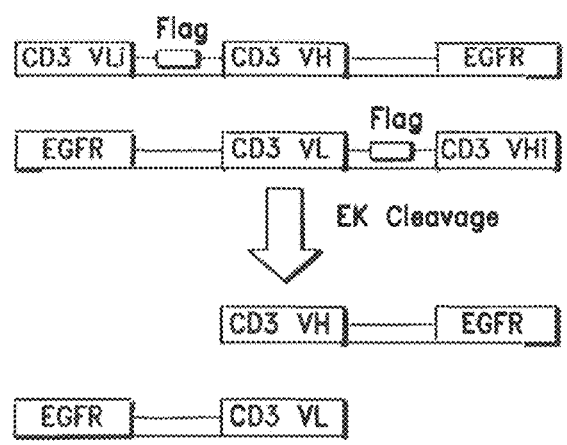
Figure 9:
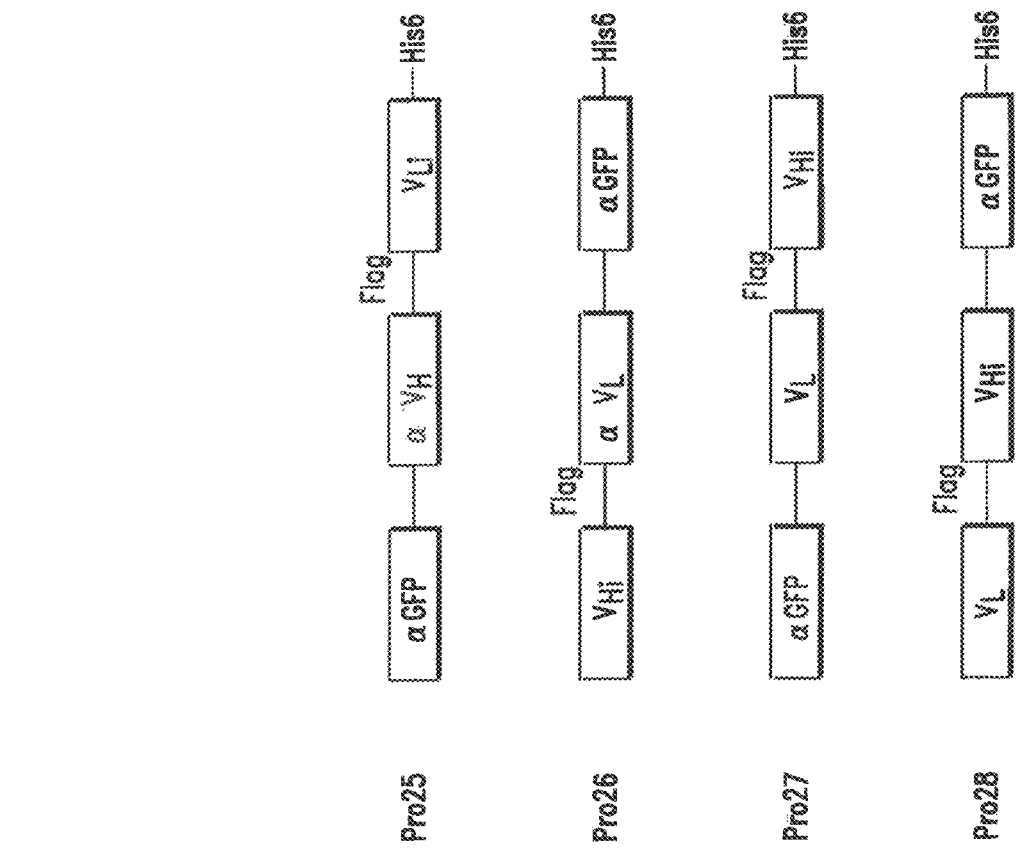
FIG. 9 shows some non-target controls for use in the assays to test efficacy of the Format 1 constructs.
Figure 10A:
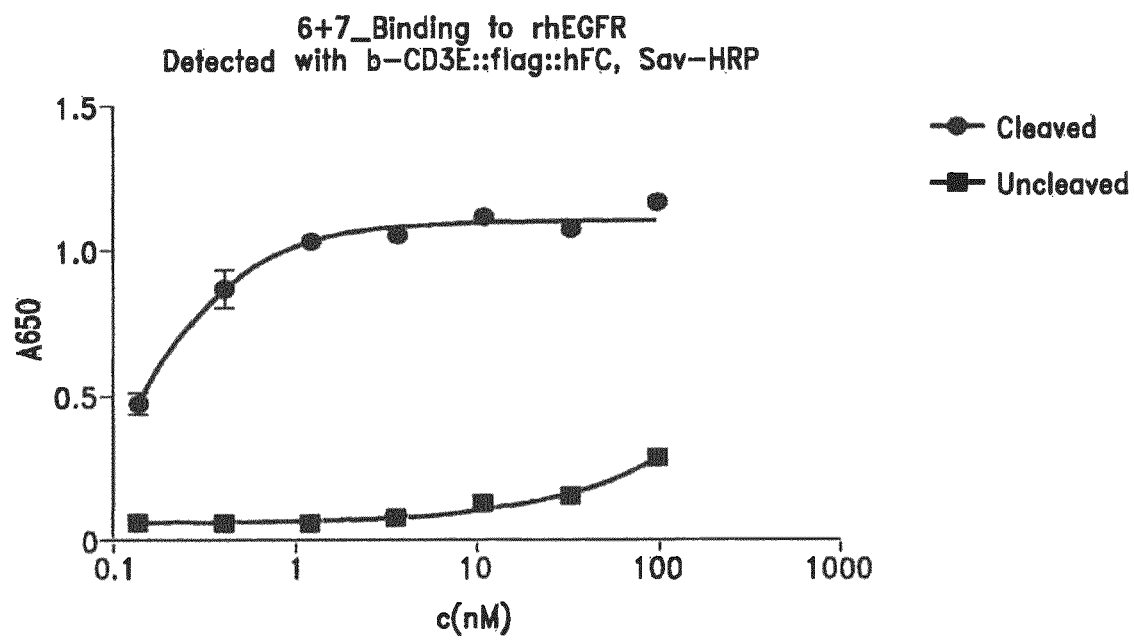
FIG. 10A-FIG. 10F shows the generation of an active CD3 binding domain is dependent on target binding of both "arms", e.g. the sdABD-TTA domains, one of which is on each of the two constructs. The ELISA assay was performed as described in the Examples.
Figure 10B:
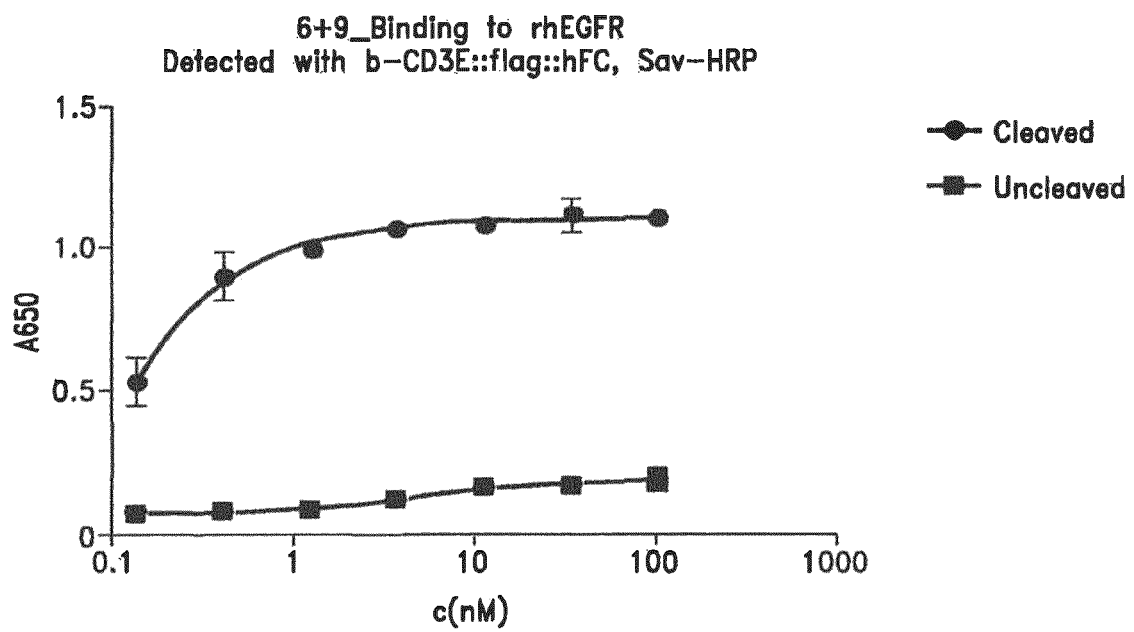
Figure 10C:
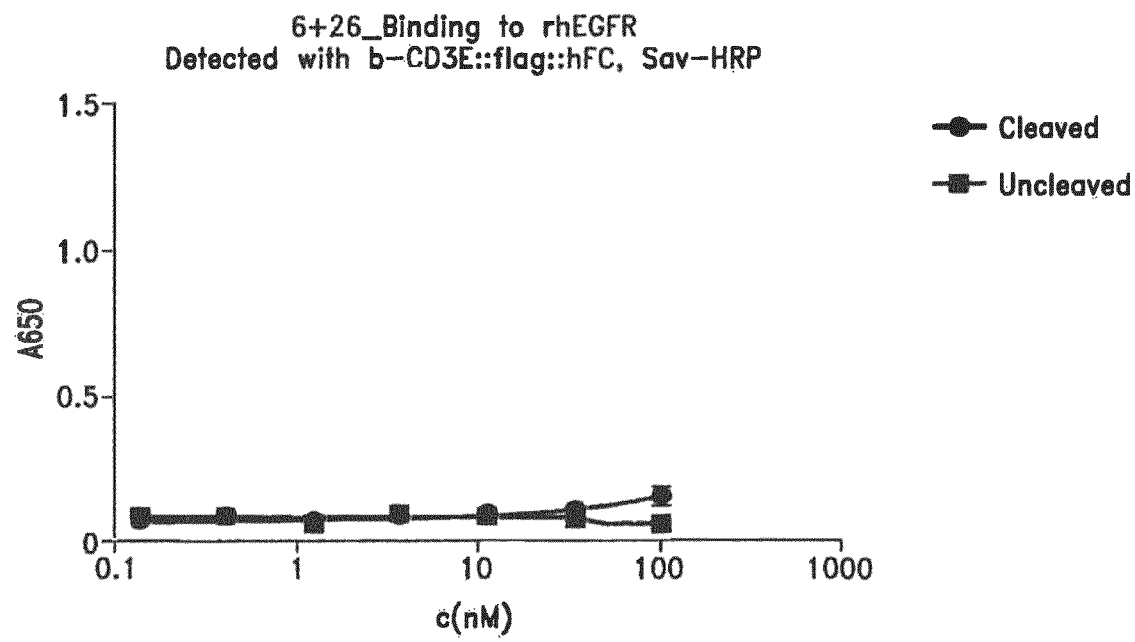
Figure 10D:
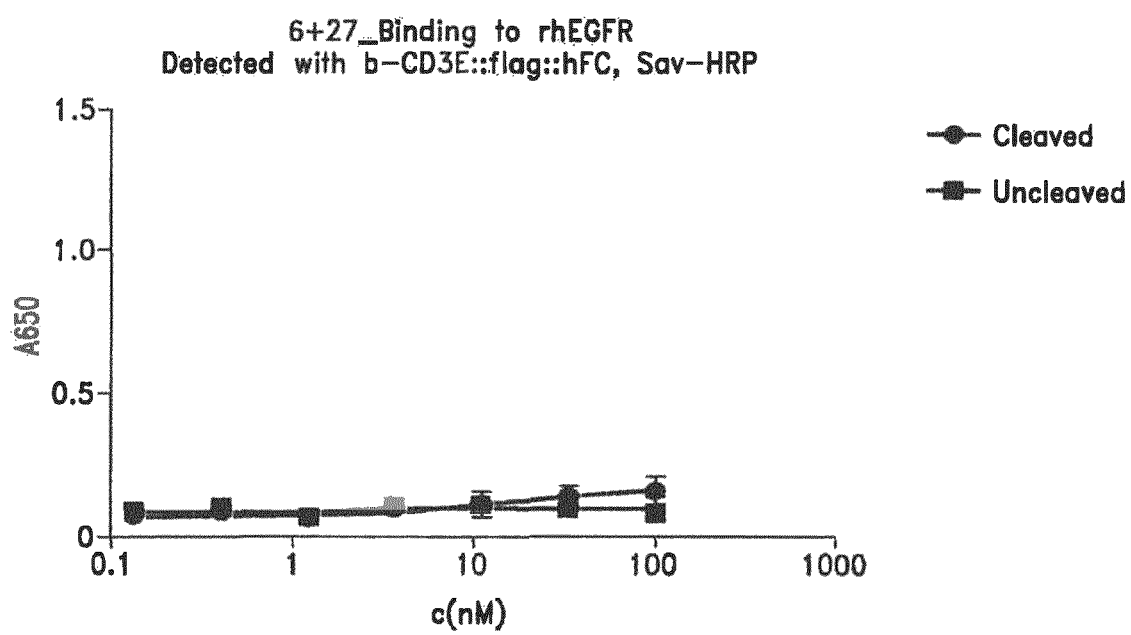
Figure 10E:
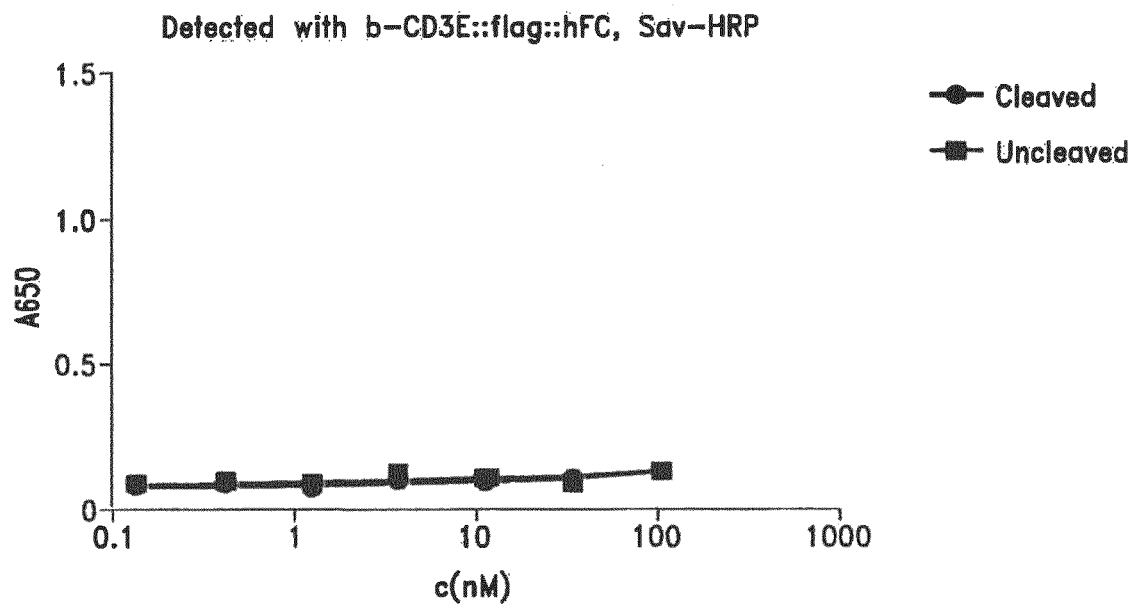
Figure 10F:
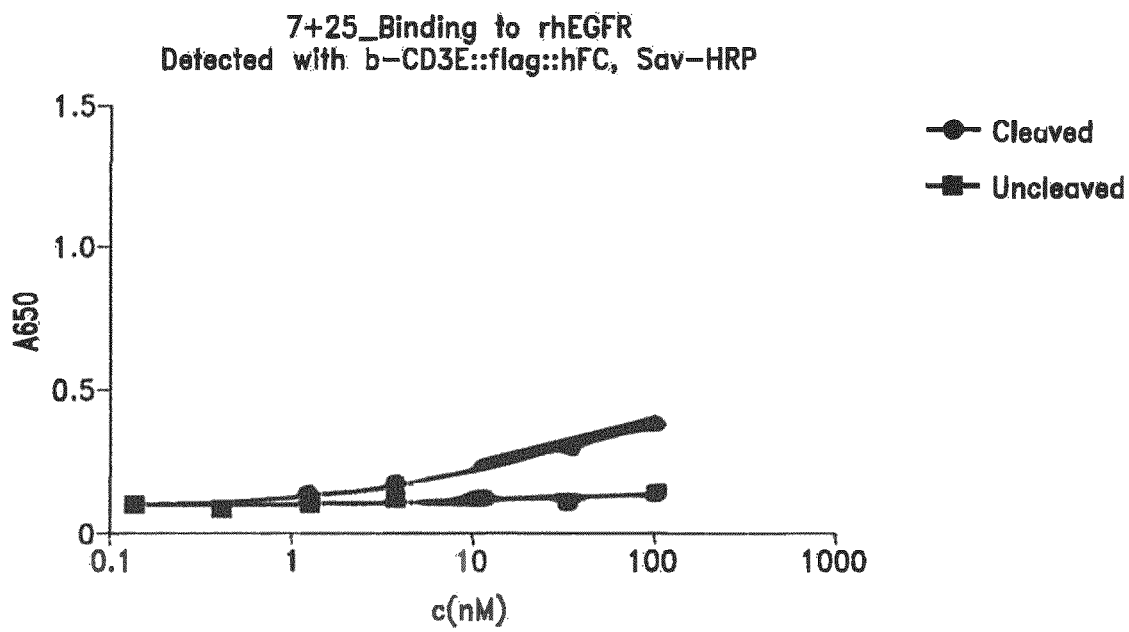
Figure 11:
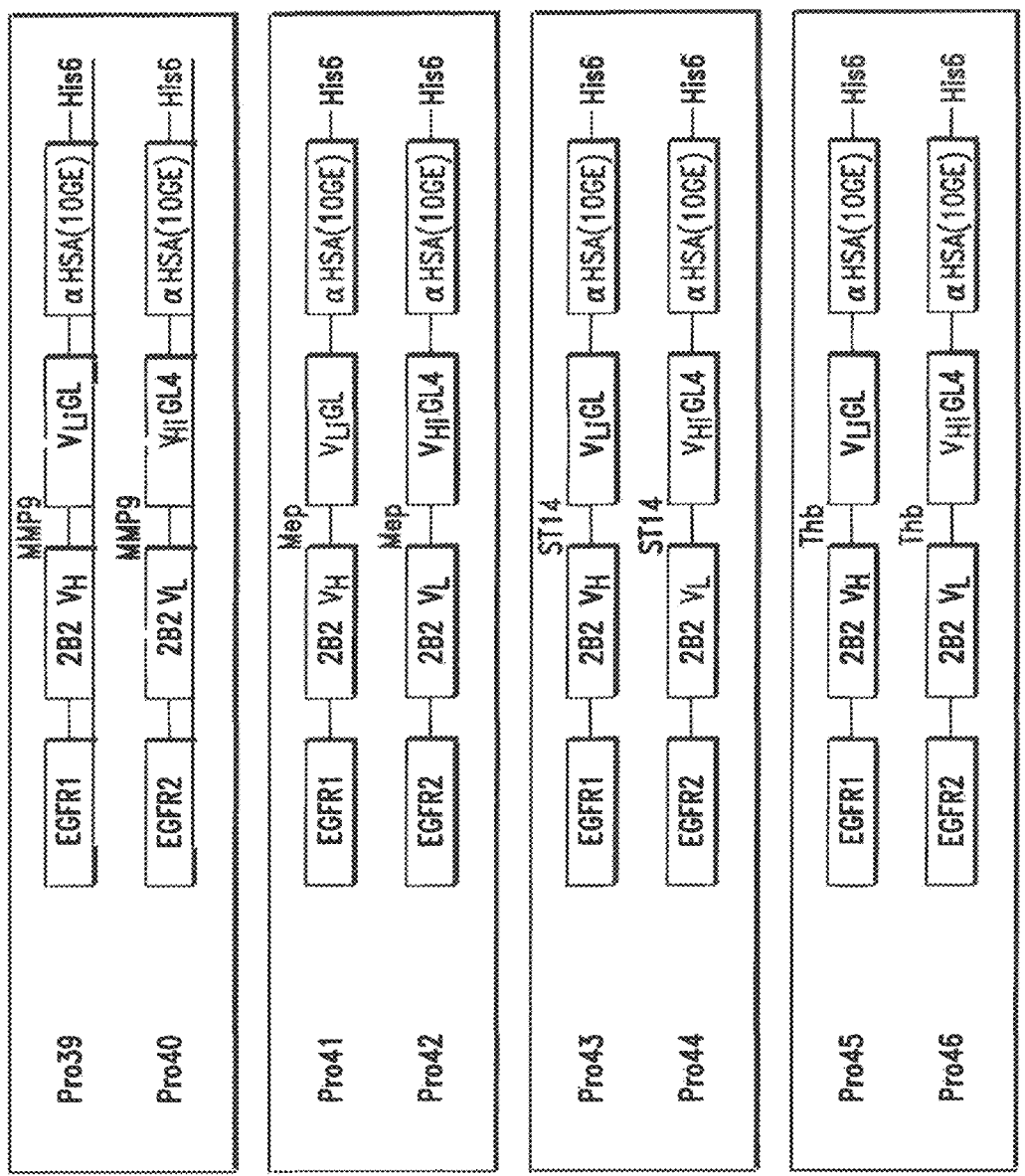
FIG. 11 shows the schematic of suitable hemi-COBRA™ pairs. "Mep" stands for a meprin protease cleavage site, "His-6" is a tag as more fully discussed herein, ST14 is a matriptase protease cleavage site and "Thb" is a thrombin protease cleavage site.
Figure 12A:
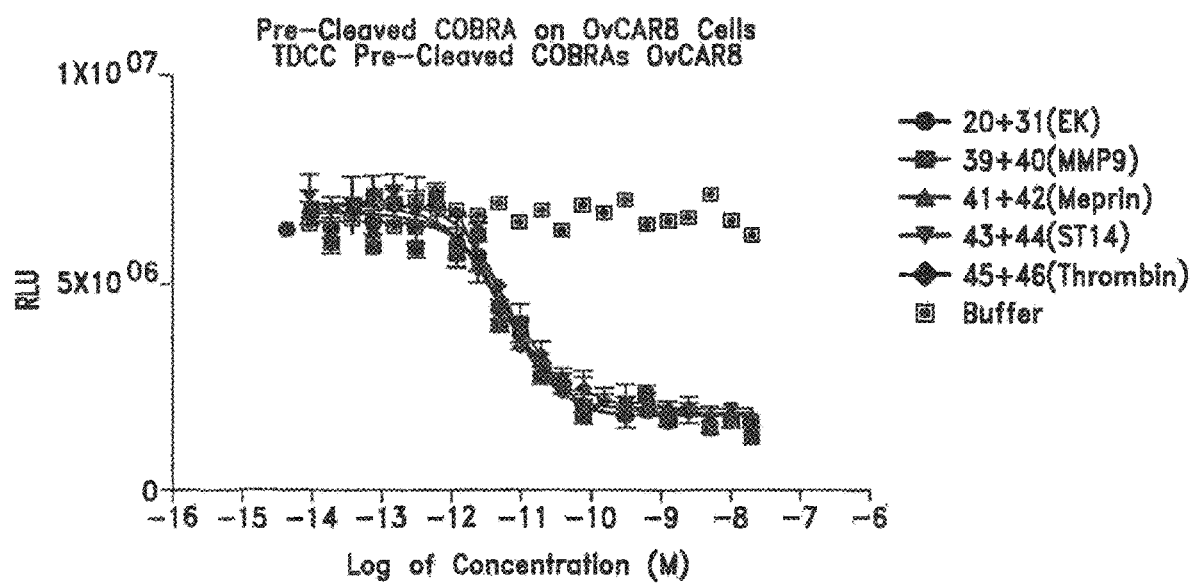
FIG. 12A-FIG. 12C shows the TDCC data associated with the constructs of FIG. 11.
Figure 12B:
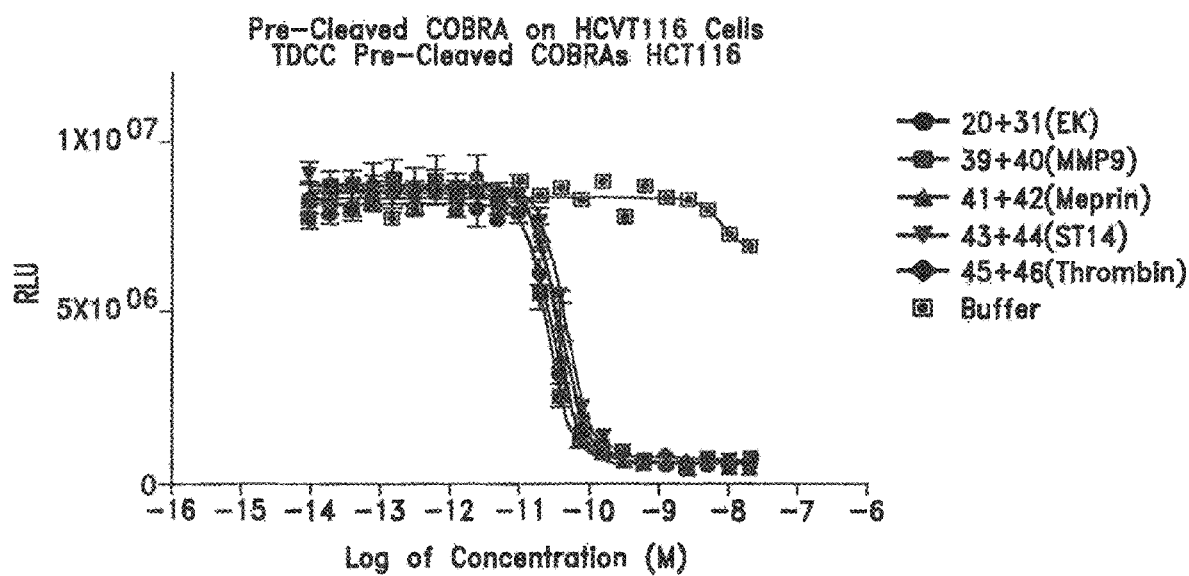
Figure 12C:
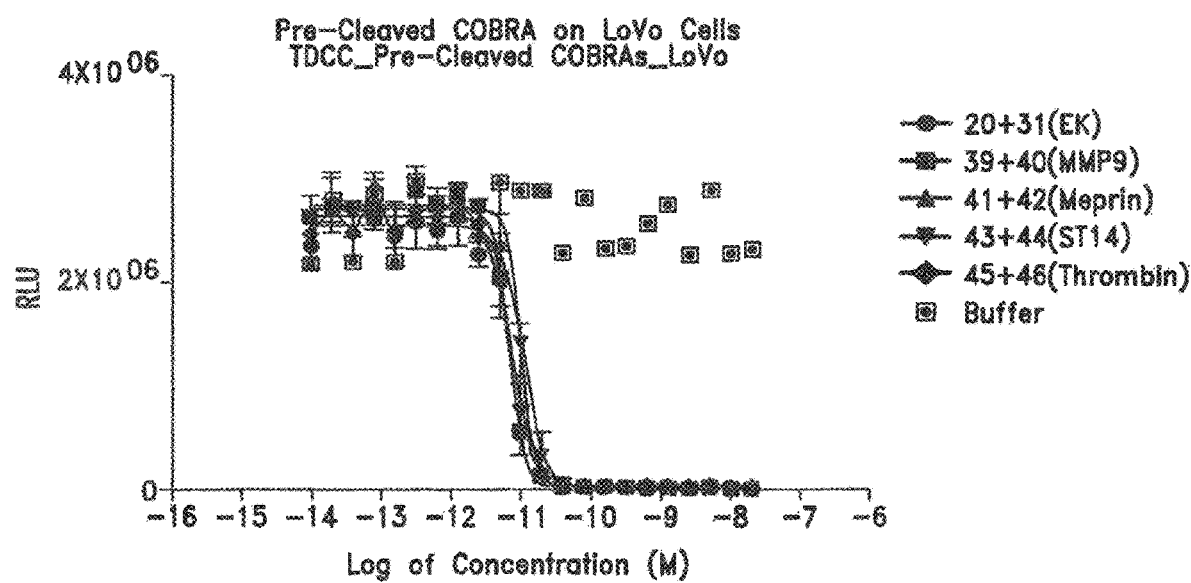
Figure 13A:
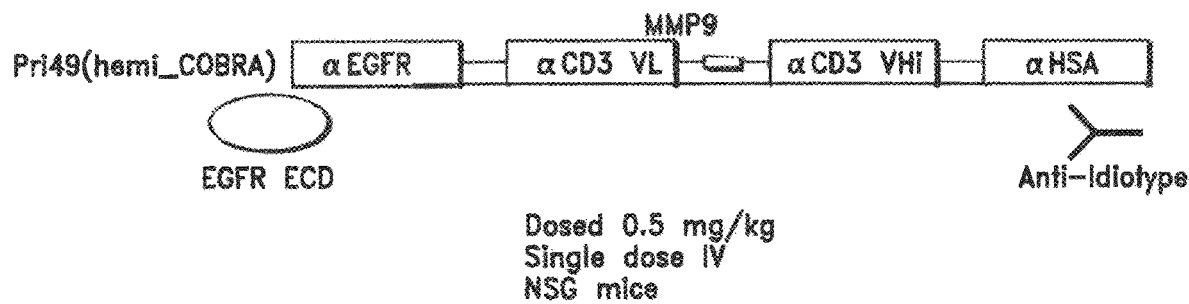
FIG. 13A-FIG. 13B shows that the MMP9 linker is stable in vivo. NSG mice were administered a single intravenous bolus dose of either Pro40 (MMP9 cleavable), Pro74 (non-cleavable) via the tail vein at a dose level of 0.5 mg/kg. The dose solution for each compound was prepared in a vehicle of 25 mM citric acid, 75-mM L-arginine, 75 mM NaCl and 4% sucrose pH 7.0. Two blood samples were collected at preselected times from each animal, one towards the beginning of the study, collected by orbital bleed or submandibular bleed, and another at the terminal time point by cardiac puncture. The time points for blood collection were 0.083, 1, 6, 24, 72, and 168h. Plasma was prepared from each individual blood sample using K2 EDTA tubes. Concentrations were determined using an MSD assay with a MAb specific to the anti-HSA sdABD and detected with the EGFR extracellular domain.
Figure 13B:
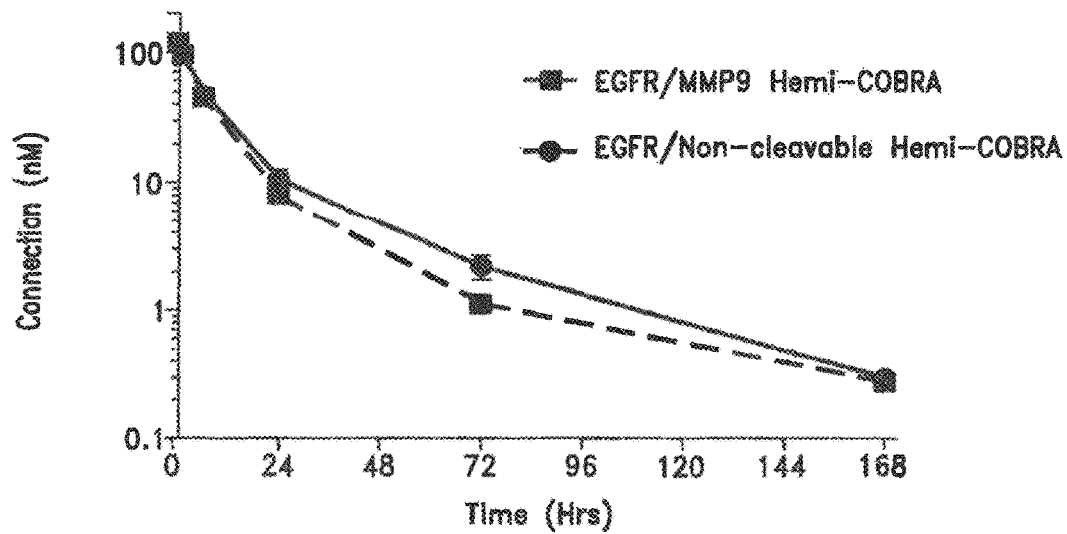
Figure 14:
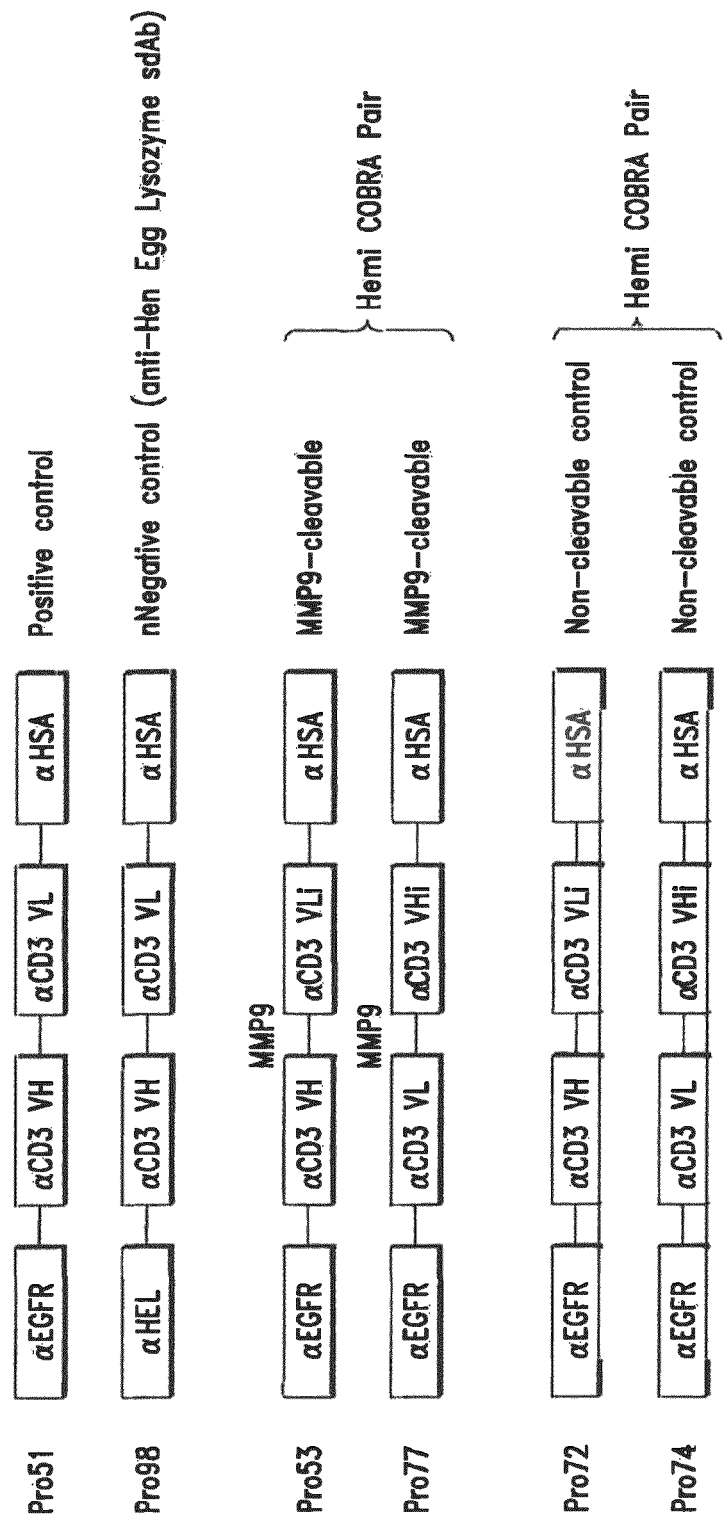
FIG. 14 depicts the schematics of the Format 3A hemi-COBRA™ constructs used in the experiments depicted in FIG. 15. Pro51 is the positive control, as it is "always on", since it forms an active anti-CD3 Fv. Pro98 is a negative control, since it's sdABD is directed against hen egg lysozyme, which isn't expressed by the tumor. Pro77 and Pro53 are the pro-drug Format 3A pair, using sdABDs against EGFR and an MMP9 cleavage site. Pro74 and Pro72 is a negative control Format 3A pair, since they don't have cleavage sites.
Figure 15:
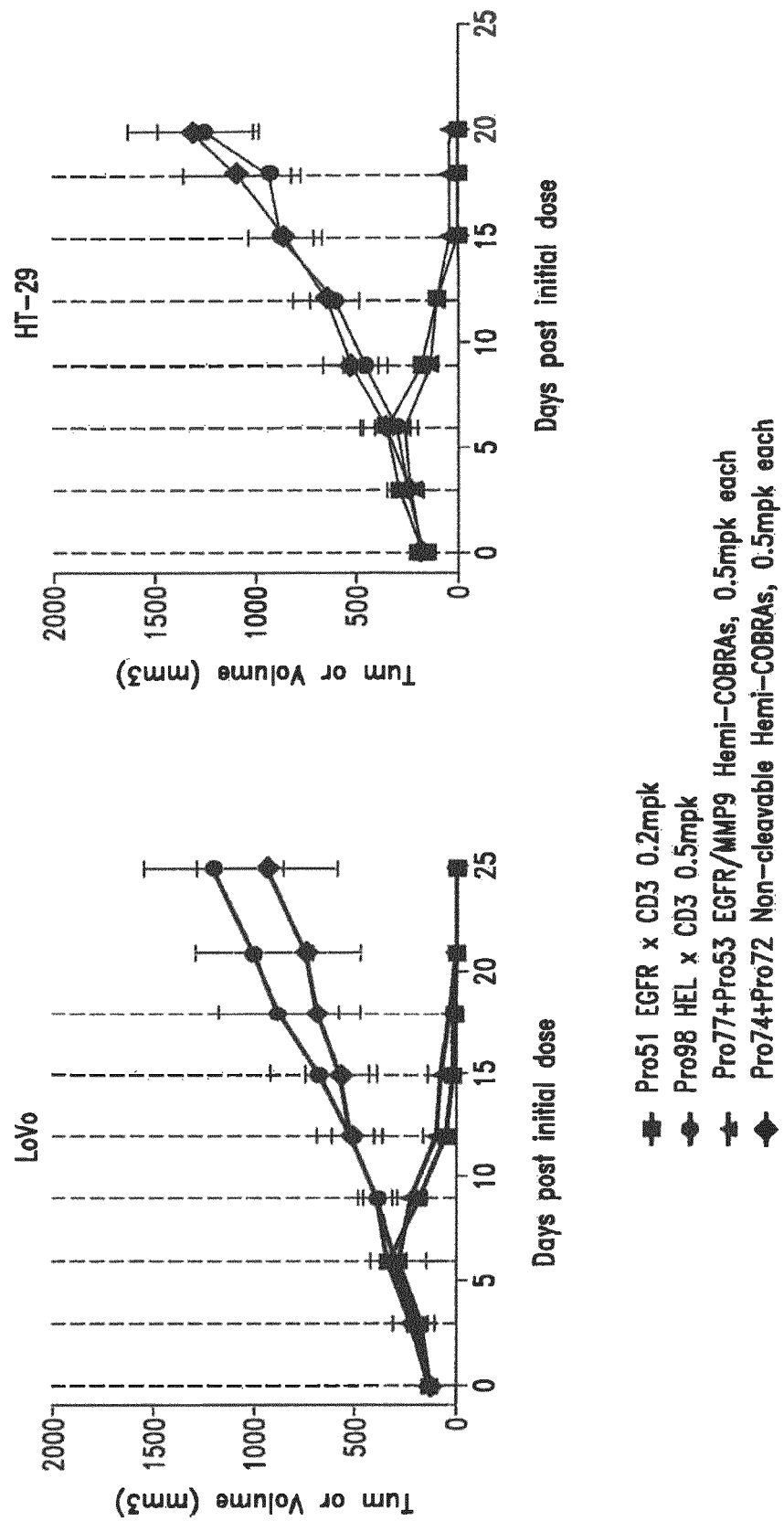
FIG. 15 shows that Format 1 constructs work to regress tumors in vivo, using two different tumor cell lines implanted into mice using the protocols in the Examples. Anti-tumor activity with the hemi-COBRA constructs (Pro77 and Pro53) was dependent on the inclusion of both the anti-EGFR sdABDs and the MMP9 cleavable linkers, along with the active anti-CD3 Fv.
Figure 16:
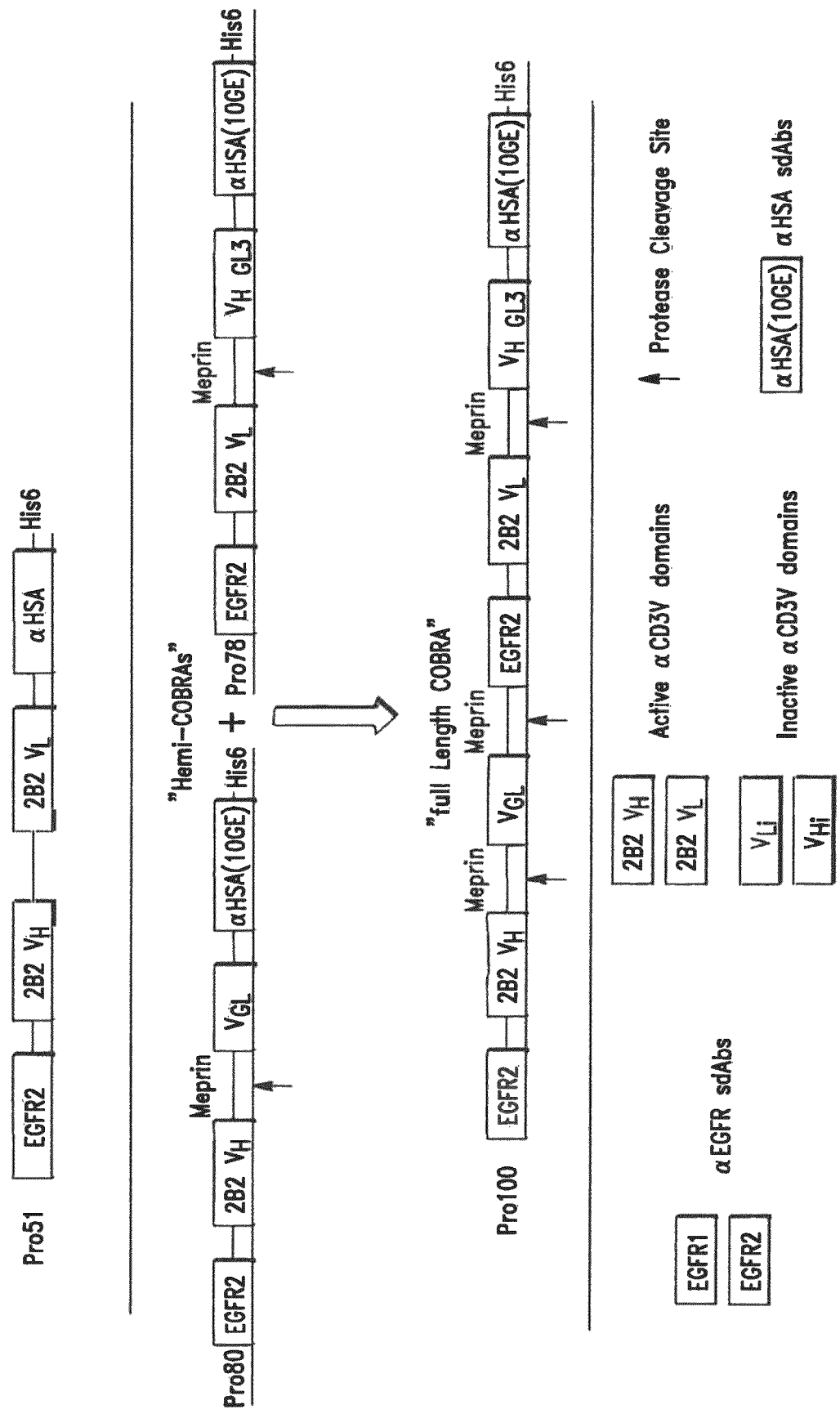
FIG. 16 shows the schematic of the next generation format, a full length construct that has two pseudo Fv domains with cleavable sites between them, as is generally described in US 2018/0134789, hereby incorporated by reference. However, as shown in the following figures, this first generation full length construct does not show very good conditionality, as it can isomerize to form both an active and inactive construct.
Figure 17:
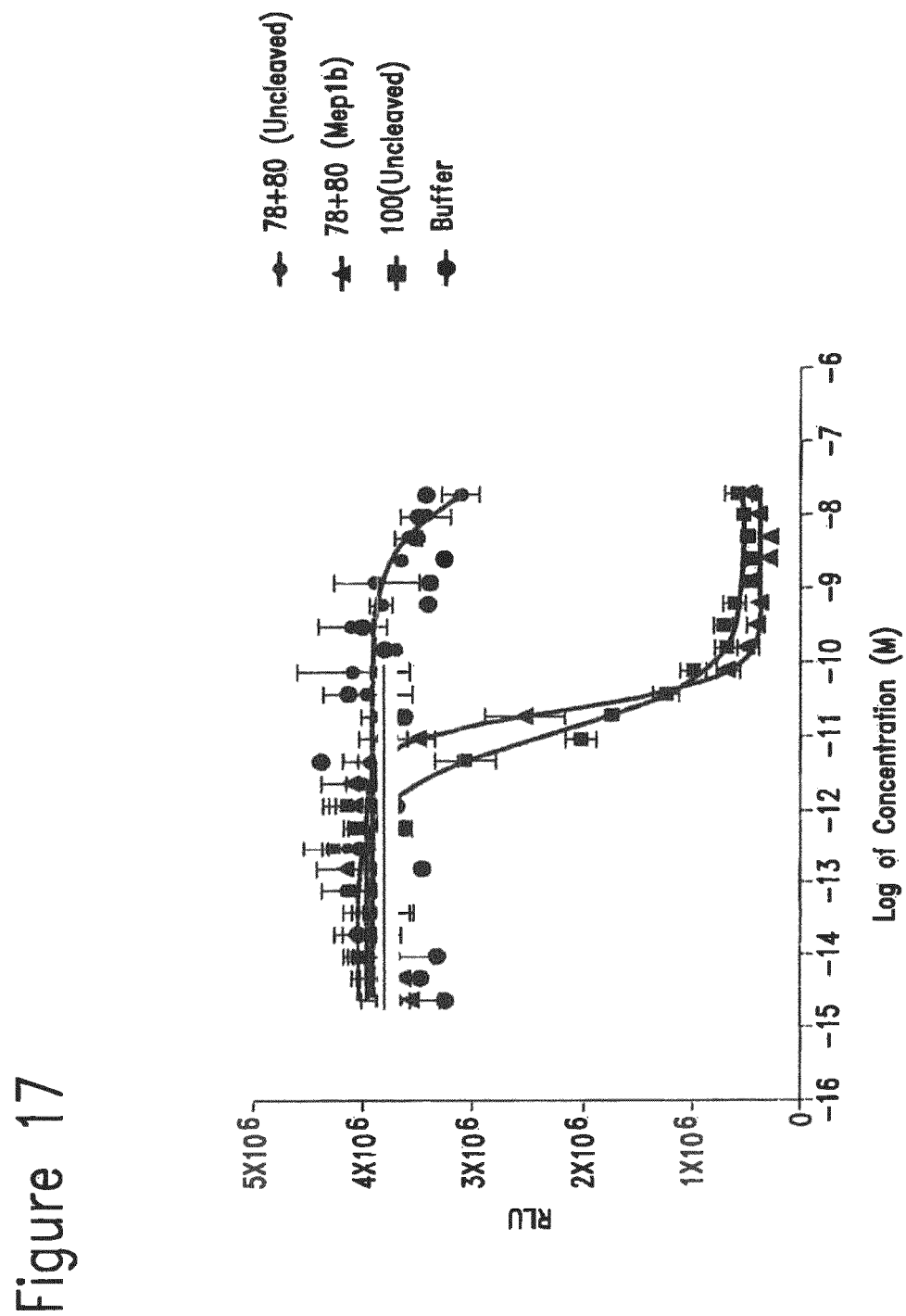
FIG. 17 shows that the Format 3A construct pairs actually show better conditionality than the Pro100 first generation full length constructs.
Figure 18:
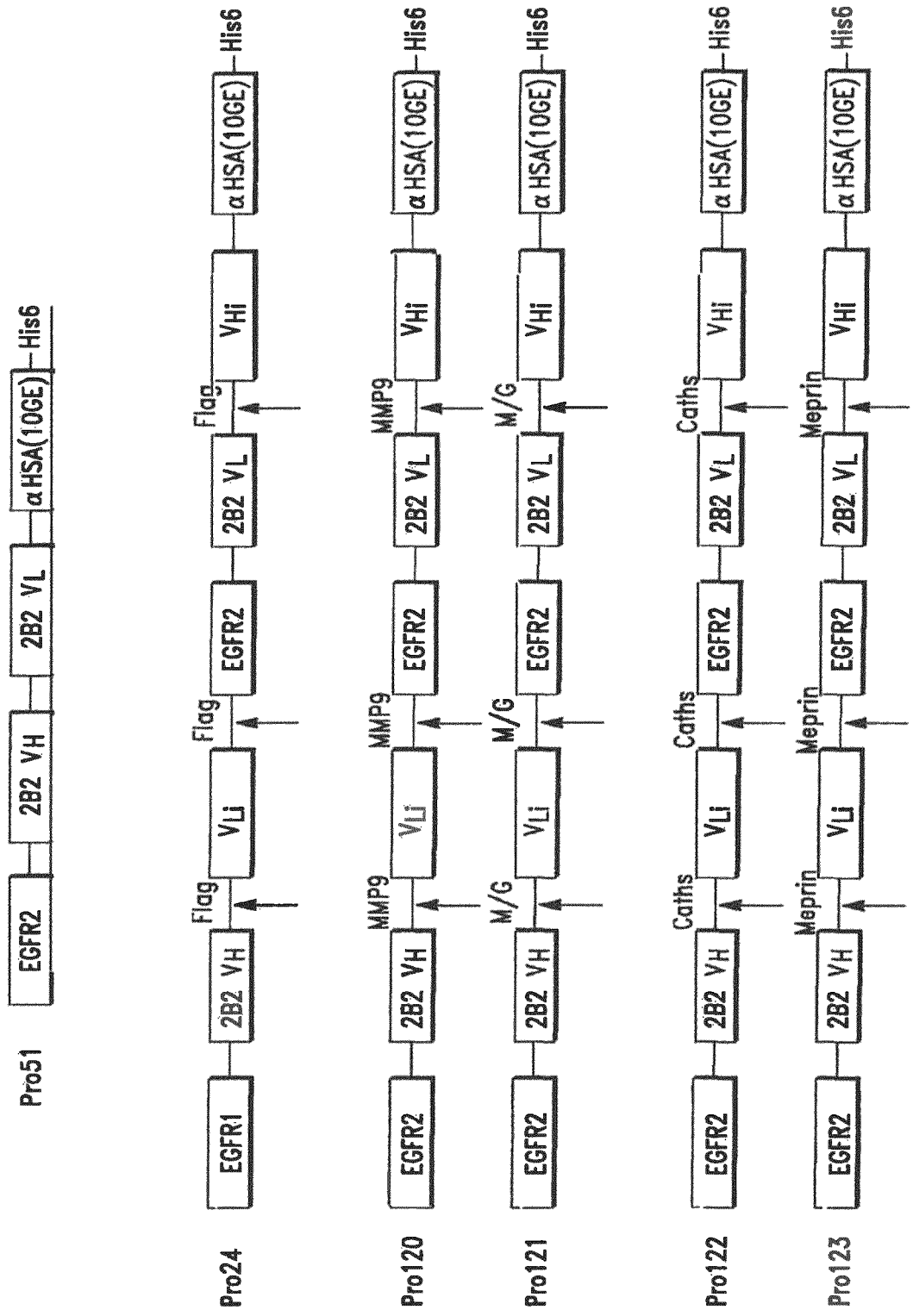
FIG. 18 depicts additional first generation full length constructs that were tested in FIG. 19.
Figure 19:
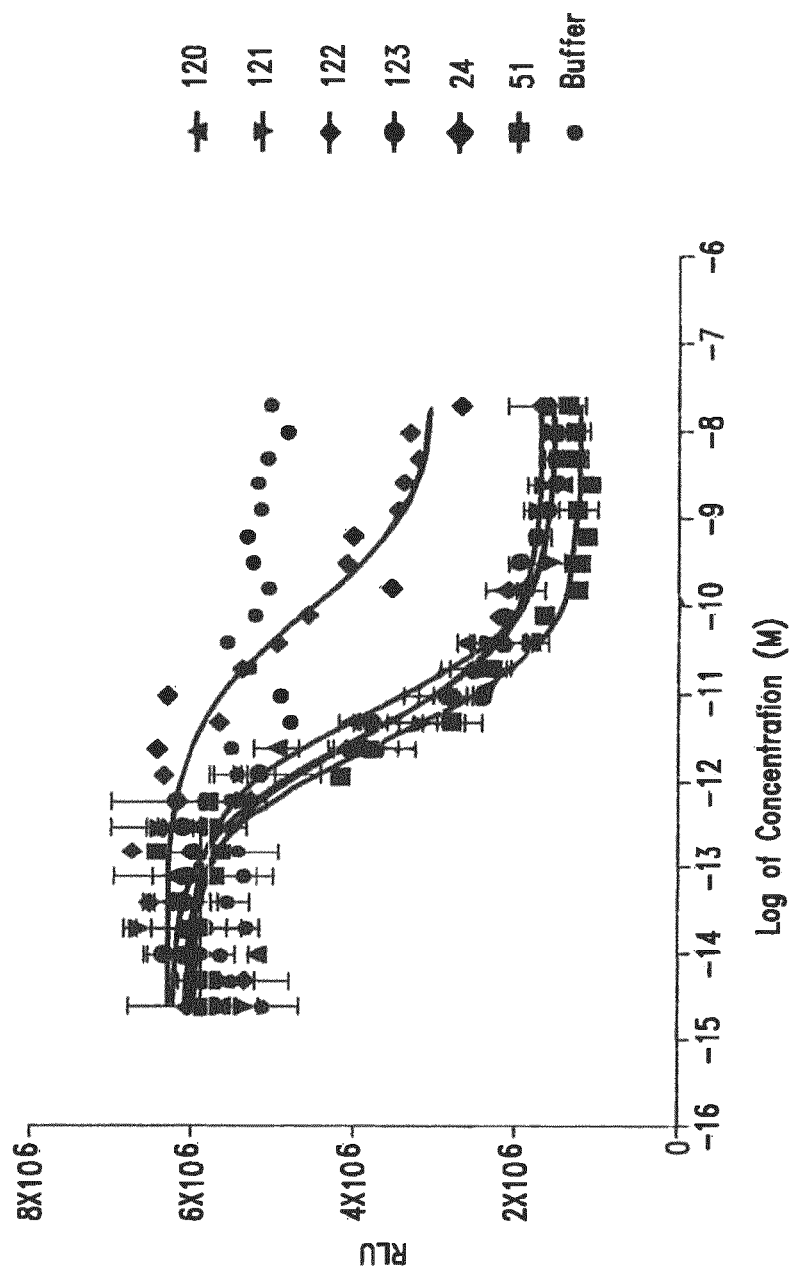
FIG. 19 shows that the first generation constructs show high activity even in the uncleaved format, e.g. poor conditionality.
Figure 20:
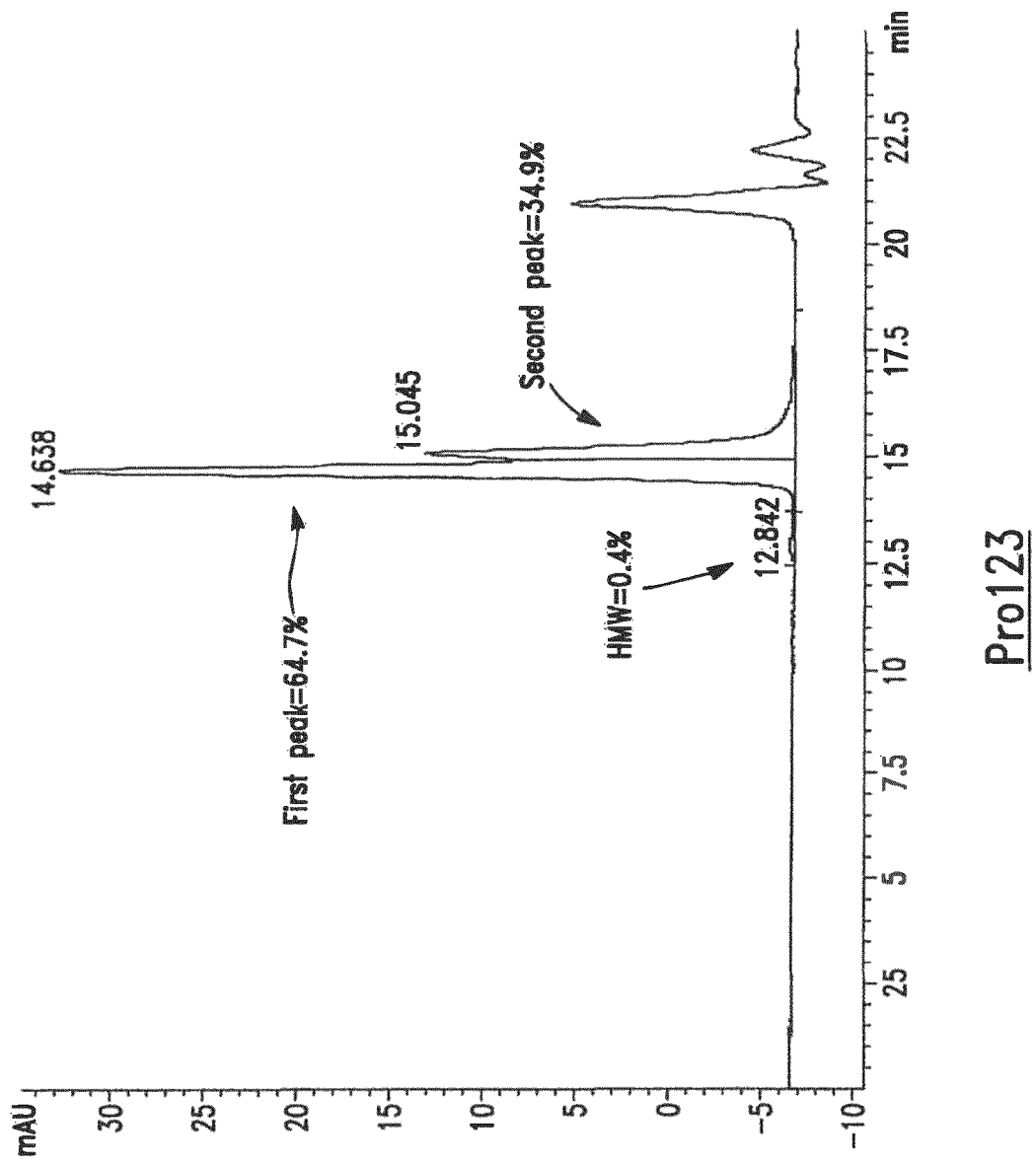
FIG. 20 shows that the first generation full length constructs show two monomer peaks on analytical SEC.
Figure 21:
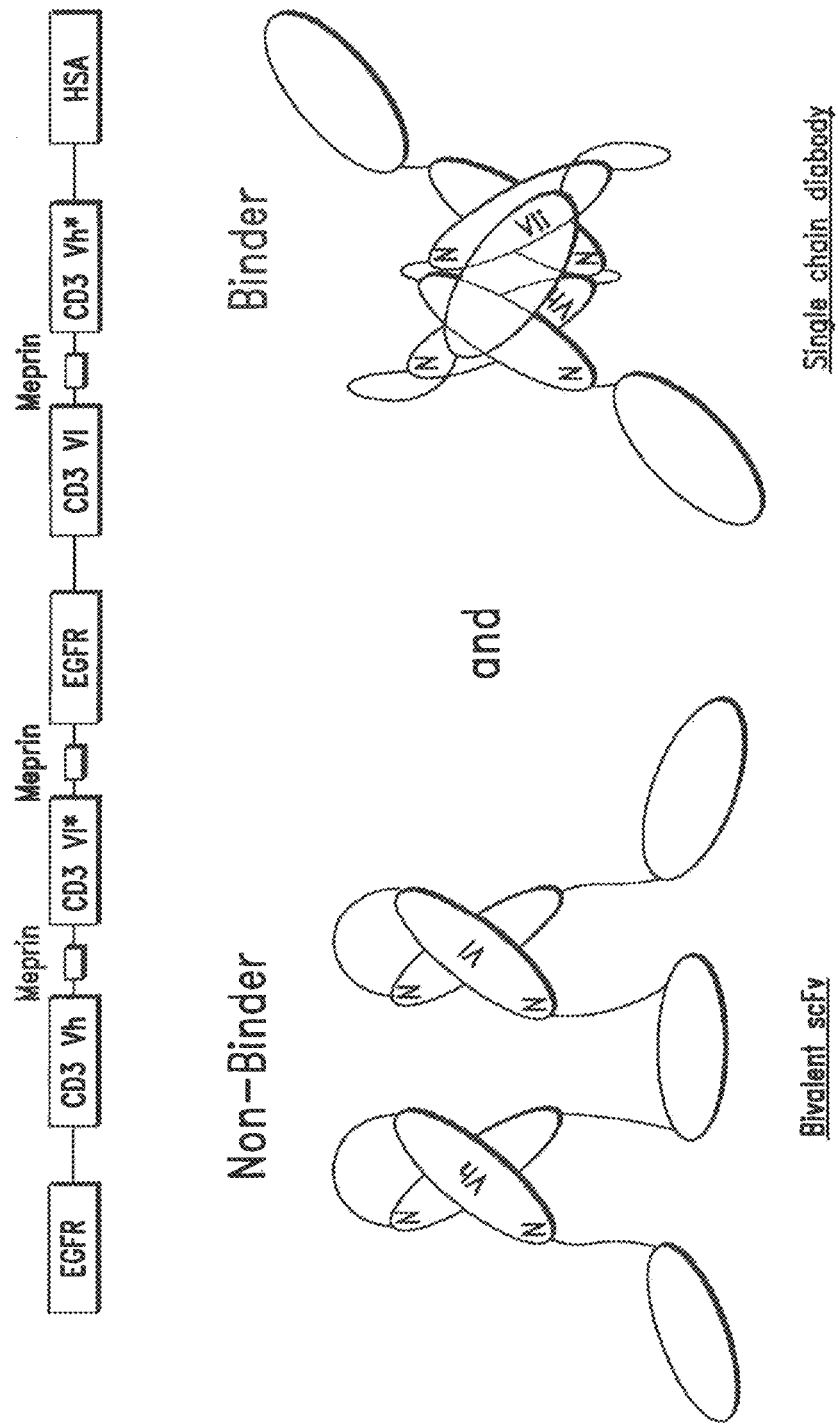
FIG. 21 shows the schematic of the reason for the noncleaved activity, which is that the full length first generation constructs isomerize to form two conformations, one which is inactive since there is no active anti-CD3 Fv formed (the "bivalent scFv"), and the other which is active in the absence of protease, a "single chain diabody" type of configuration. See PEDS 23(8):667-677 (2010).
Figure 22:
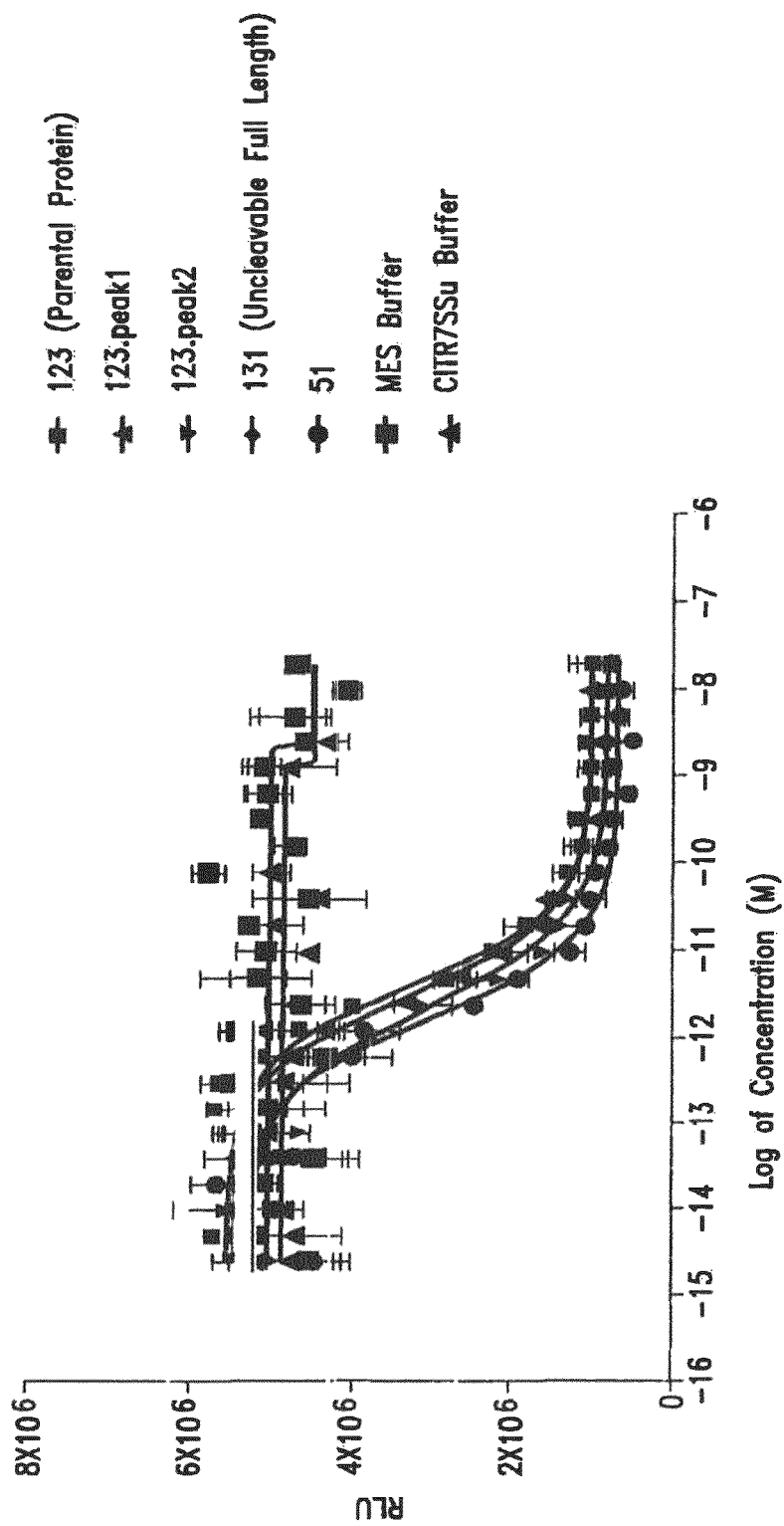
FIG. 22 shows the results of a TDCC assay, run at 37 C for 2 days, with the first generation single chain constructs. The results show that the uncleaved constructs show strong killing. These results led to the generation of the Format 1 constructs.
Figure 23A:
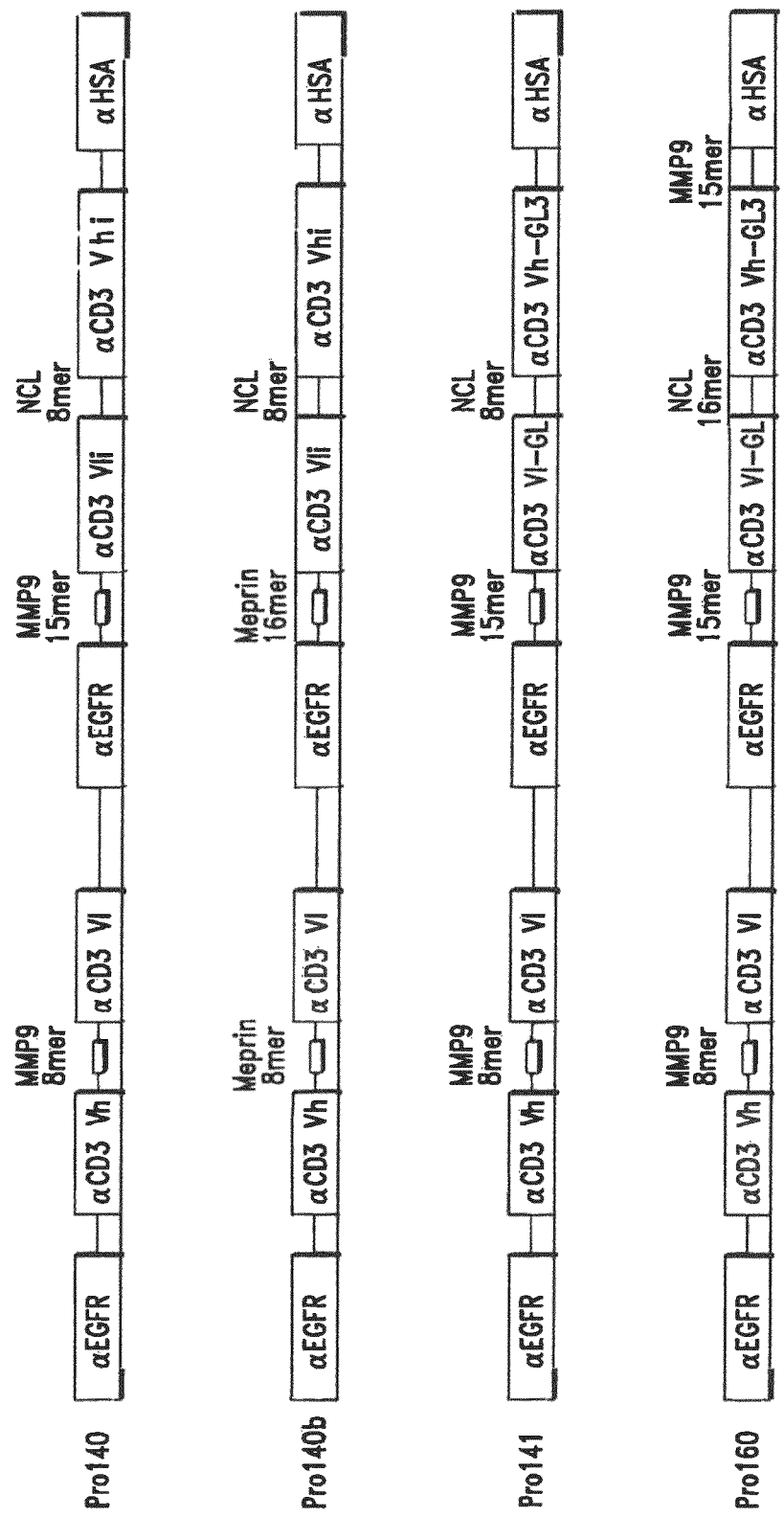
FIG. 23A-FIG. 23G shows Format 1 constructs used in the invention. As will be appreciated by those in the art and described herein, these are depicted with a sdABD-EGFR or EpCAM targeting moiety, although sdABDs to other TTAs can be used.
Figure 23B:
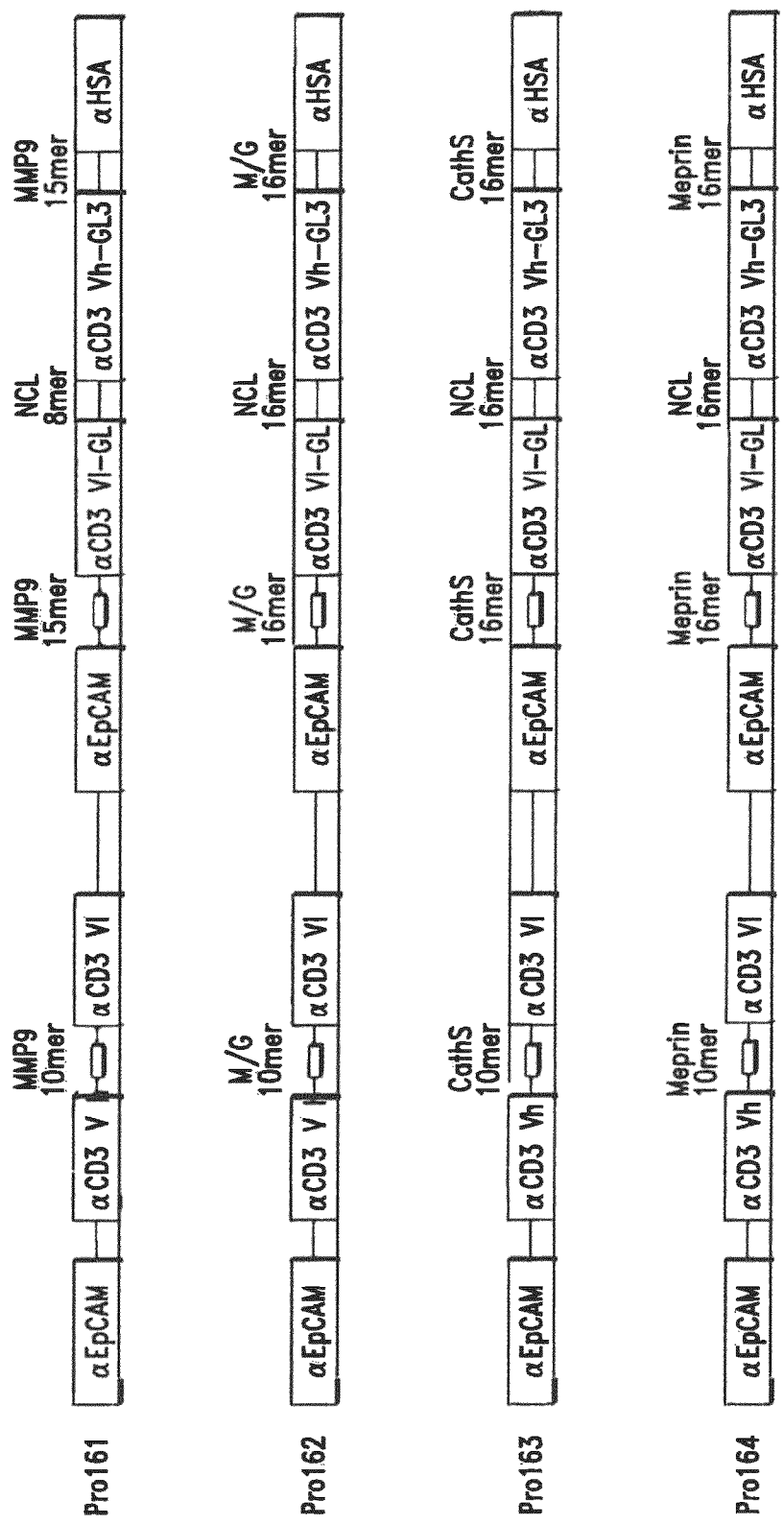
Figure 23C:
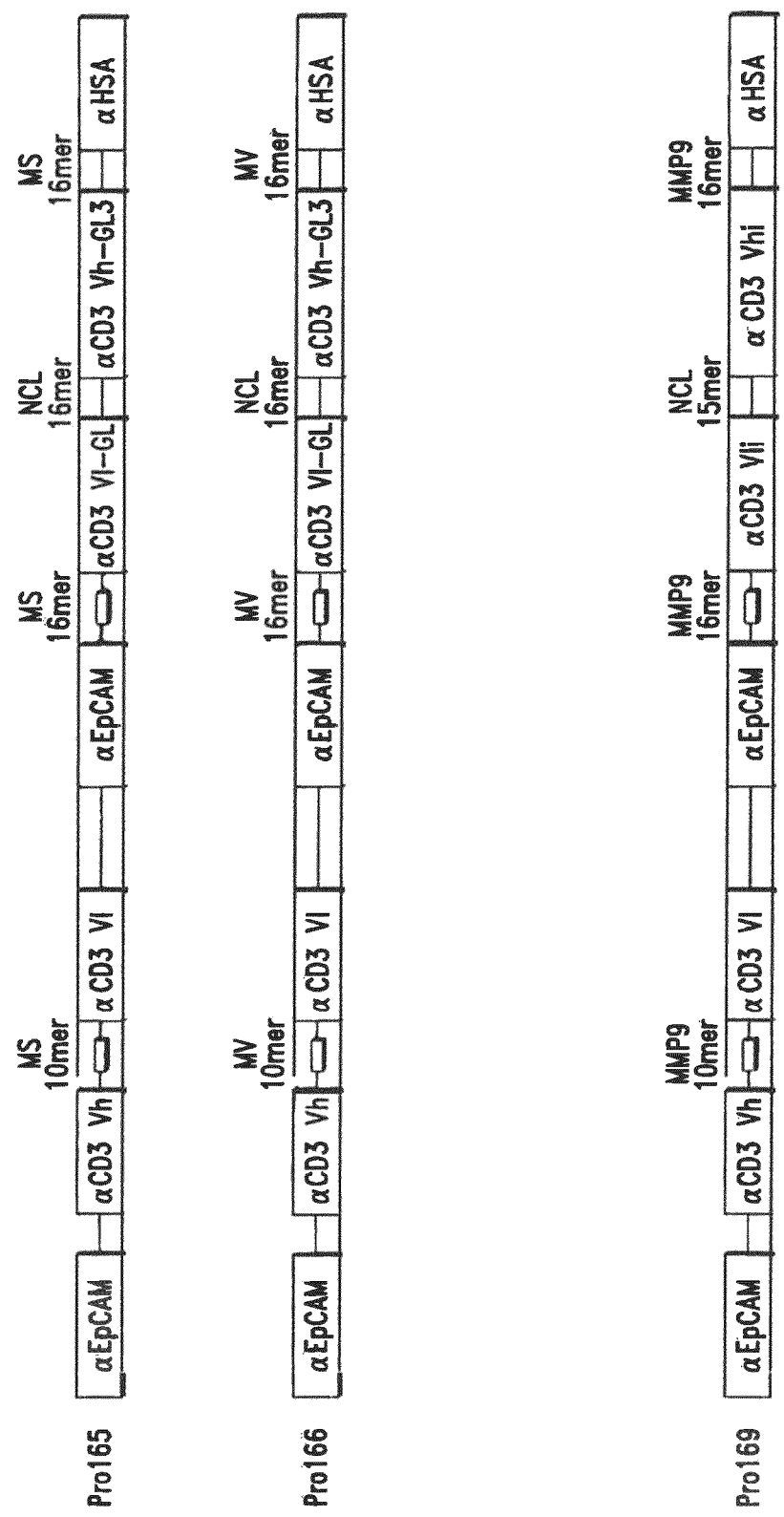
Figure 23D:
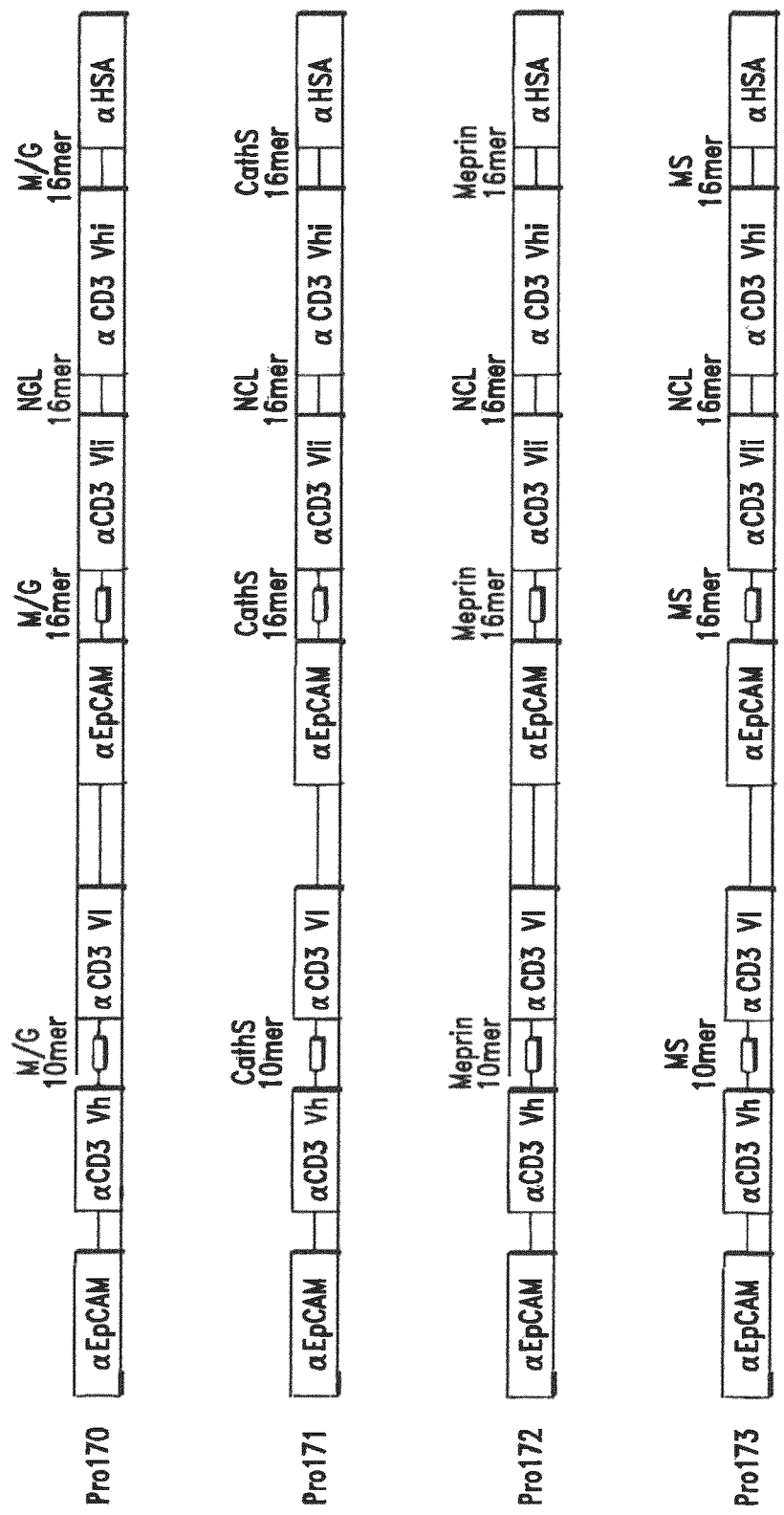
Figure 23E:
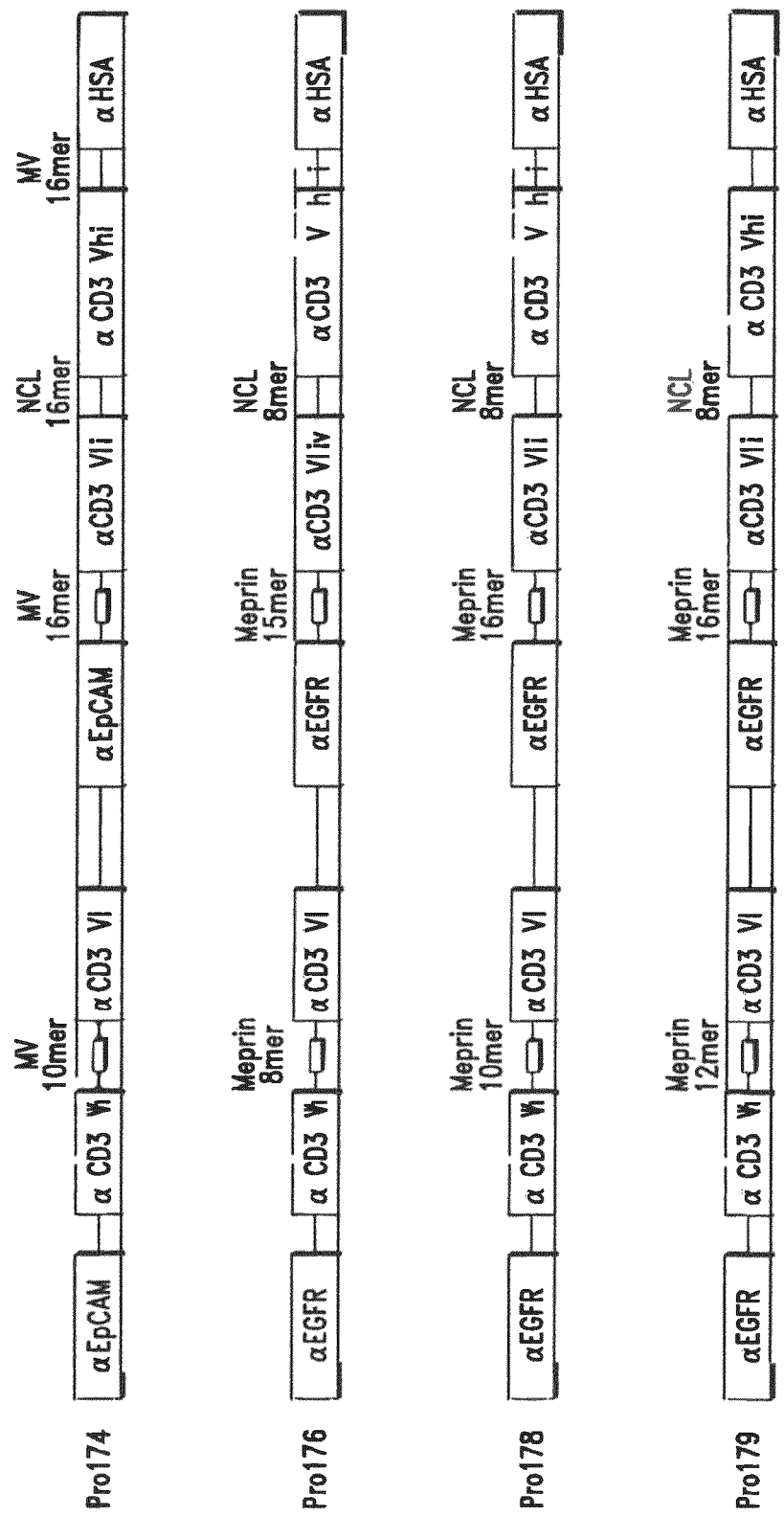
Figure 23F:
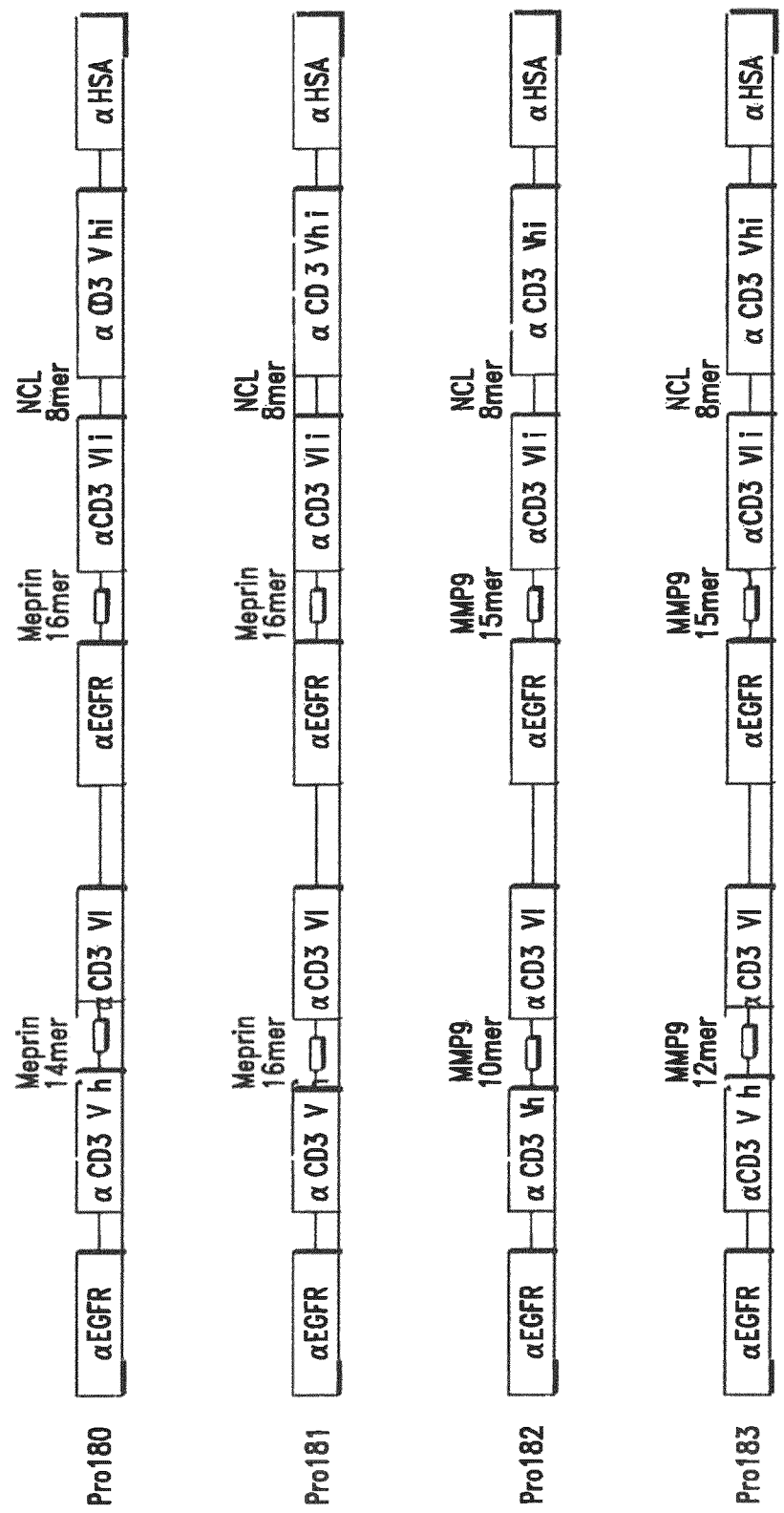
Figure 23G:
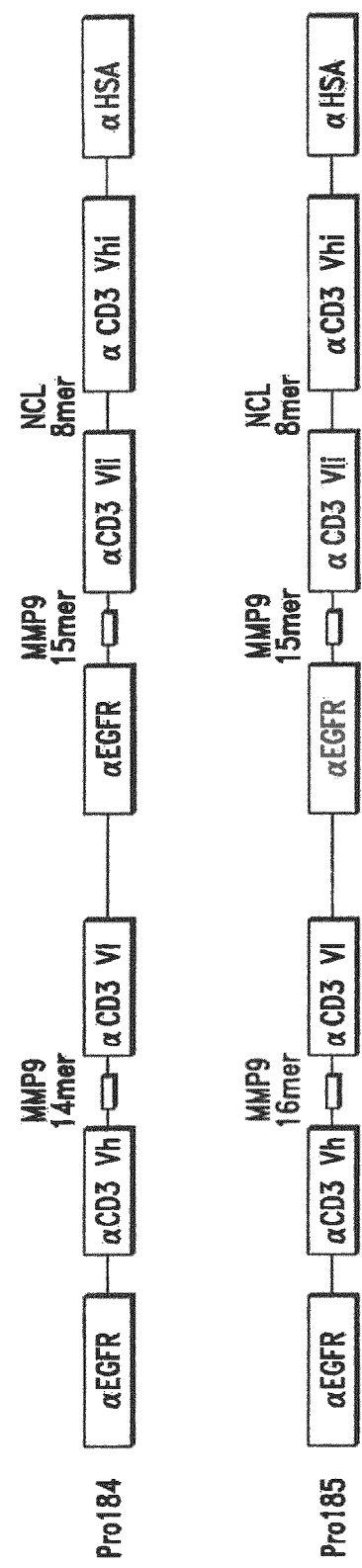
Figure 24:
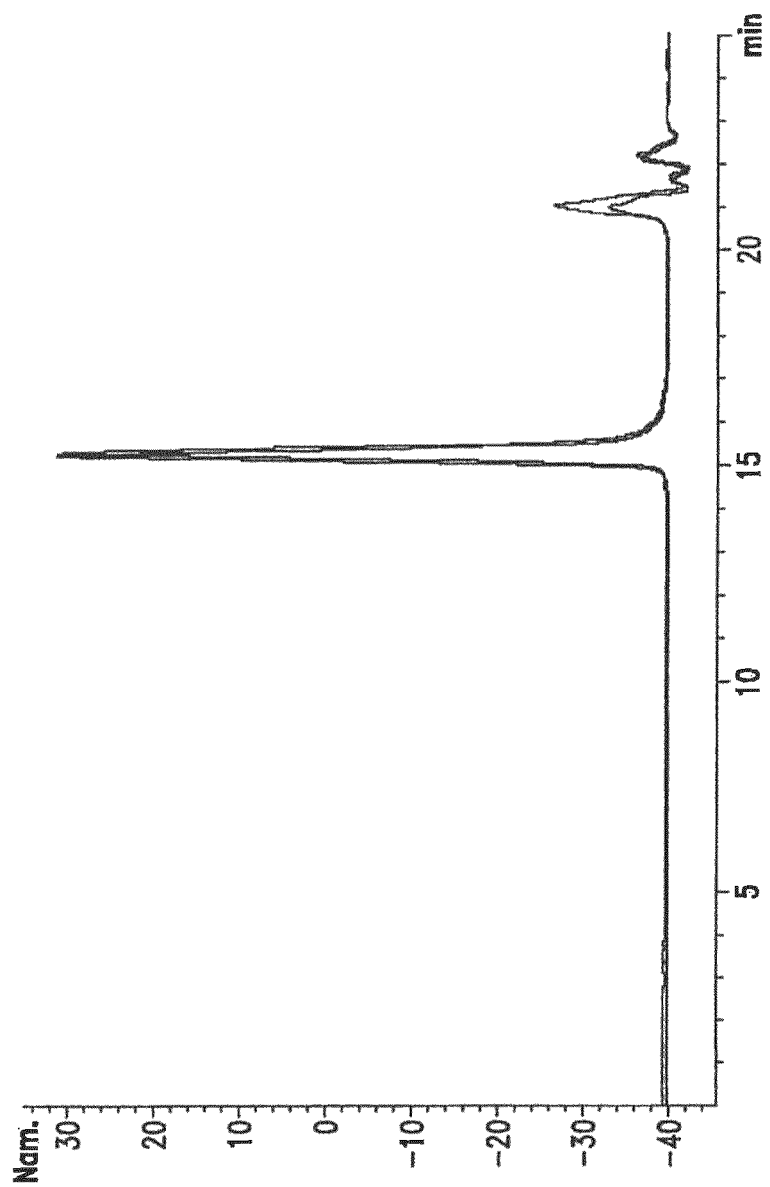
FIG. 24 shows that the Format 1 constructs (Pro140 in this case) form a single isomer that is stable at 37° C.
Figure 25:
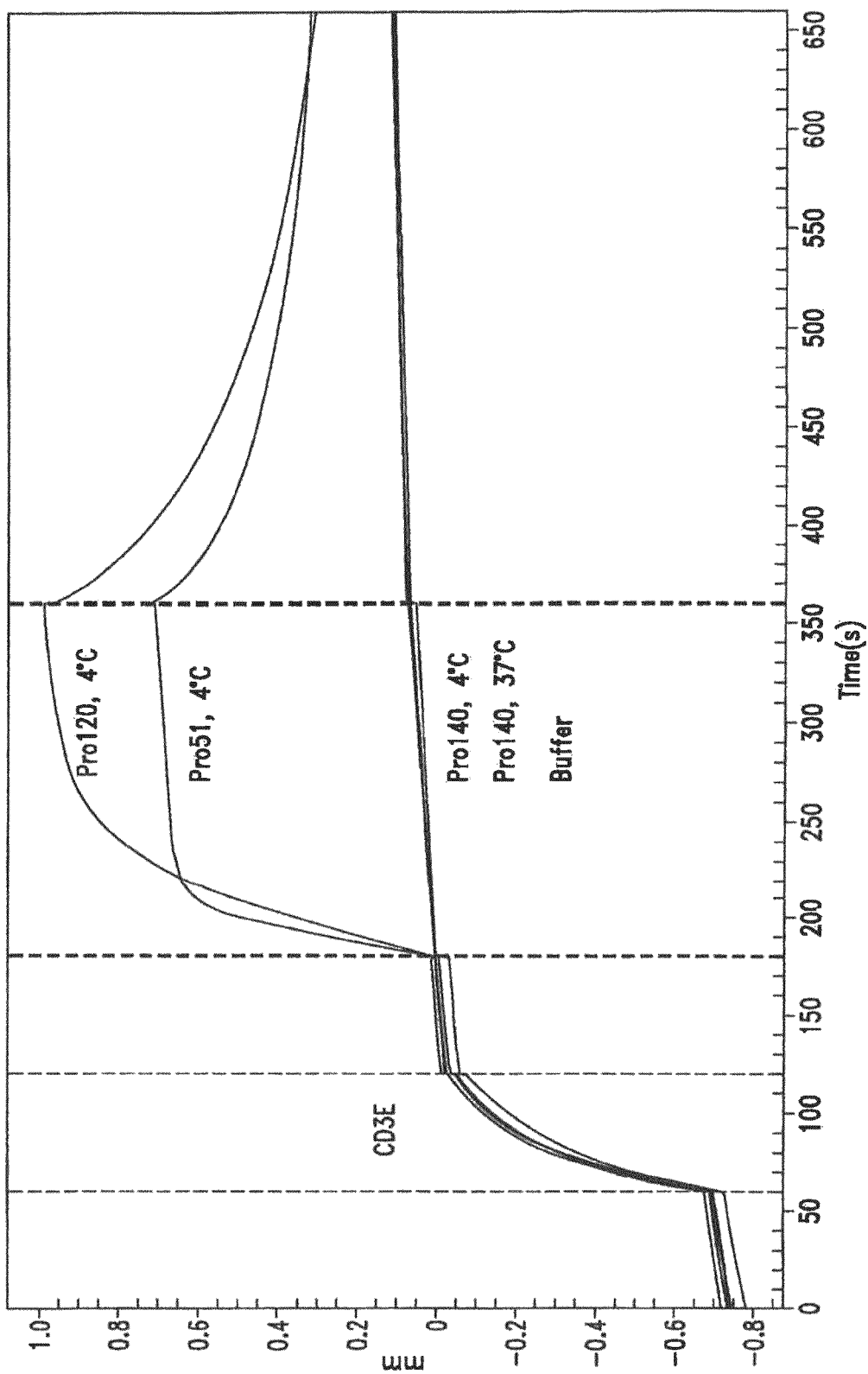
FIG. 25 depicts that Format 1 constructs have very low binding to human CD3 in the uncleaved format, as measured by an Octet assay. The top line is Pro120, the middle line is Pro51 (the positive control) and the bottom lines are Pro140 held at either 4° C. or 37° C. for 3 days.
Figure 26:
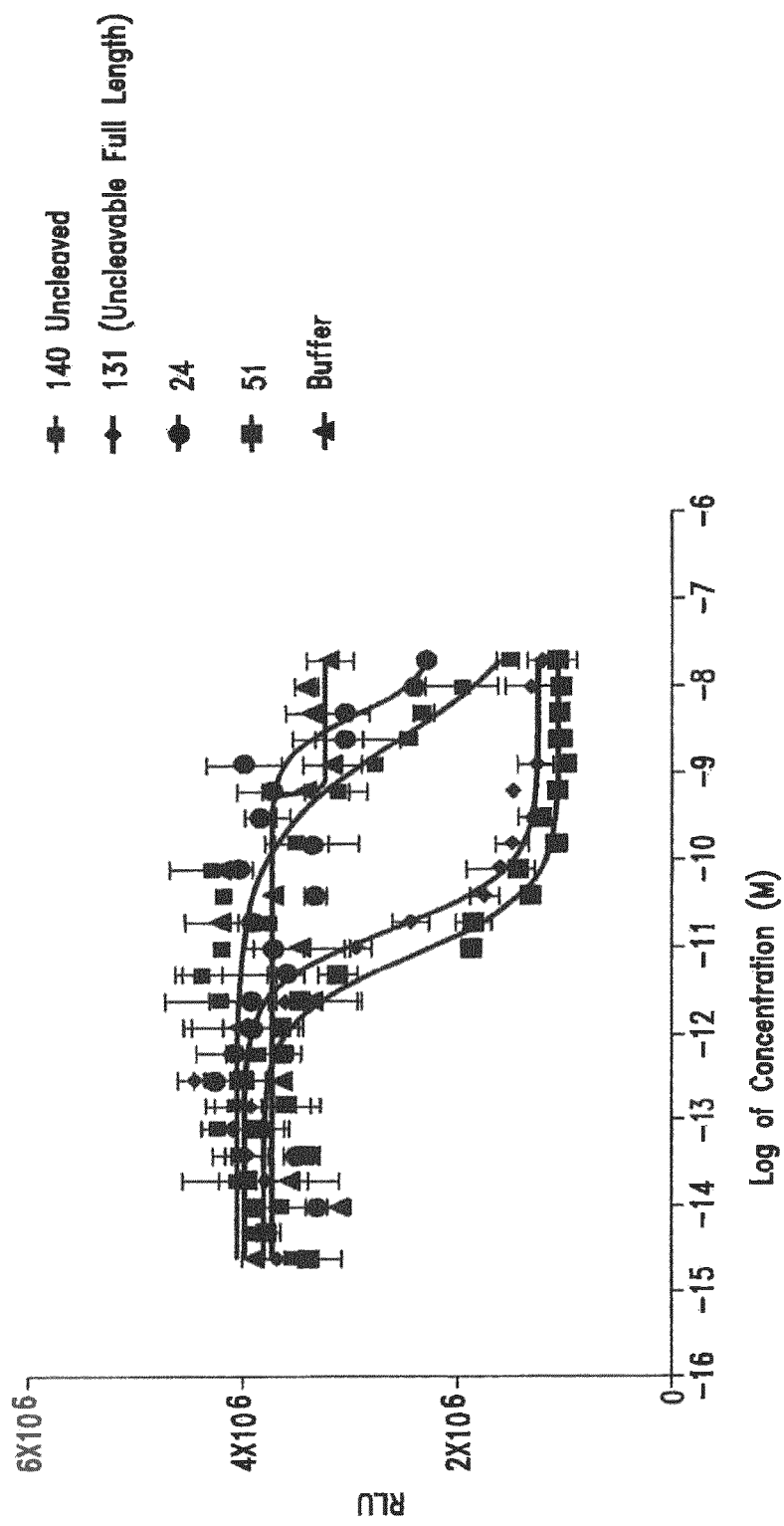
FIG. 26 similarly depicts that the Format 1 constructs have very low TDCC activity in the uncleaved form.
Figure 27:
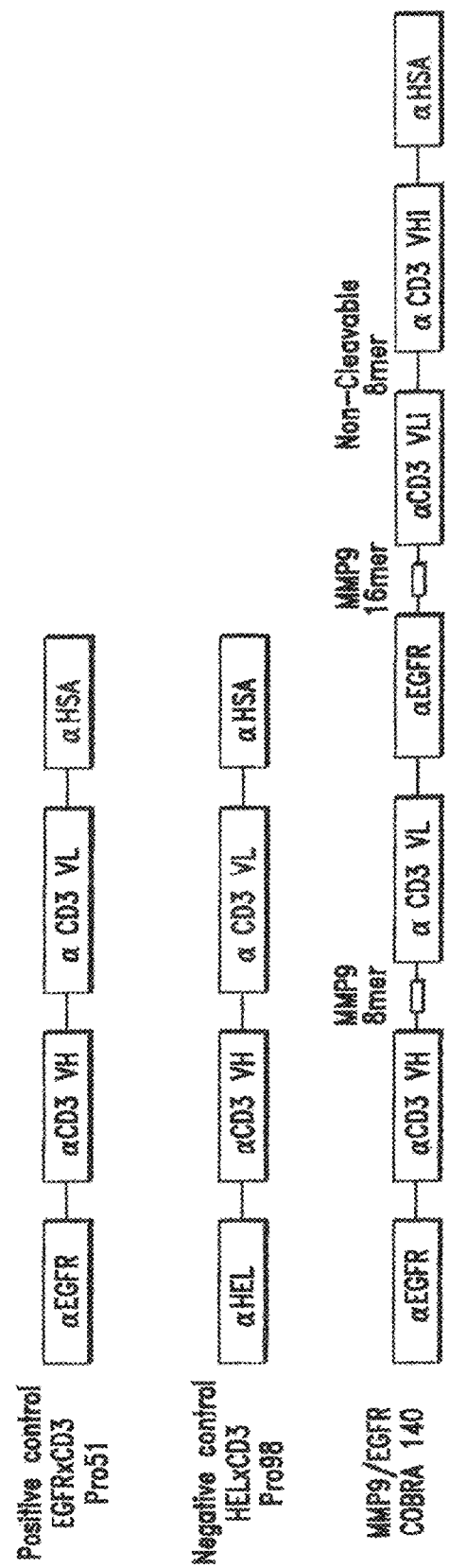
FIG. 27 depicts a specific Format 1 construct, Pro140, used in in vivo testing, using sdABD-EGFR as the targeting moieties and an MMP9 cleavage site.
Figure 28A:
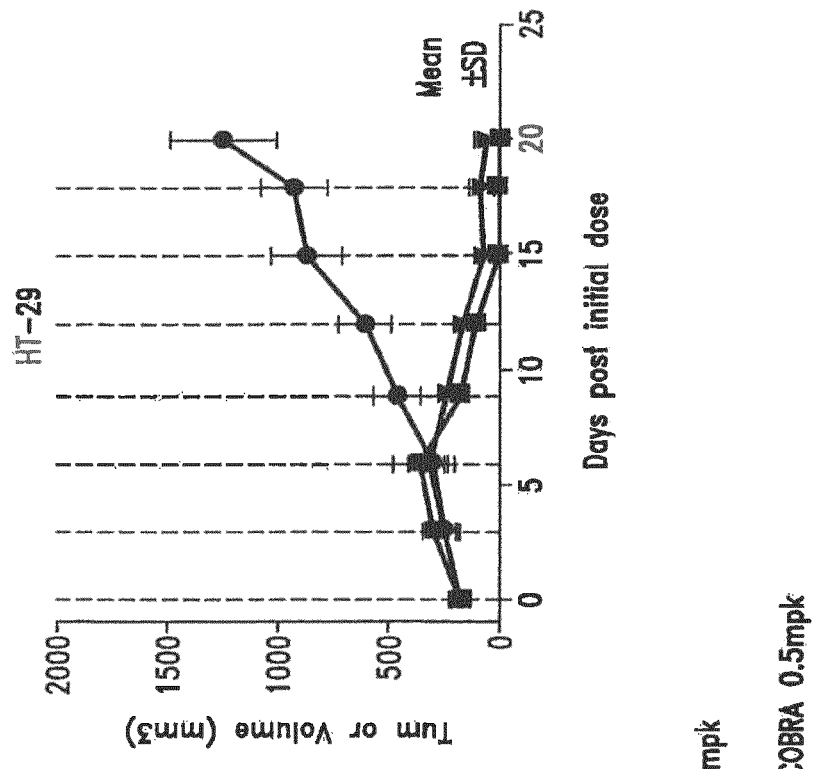
FIG. 28A-FIG. 28B shows tumor regression using a Format 1 construct.
Figure 28B:
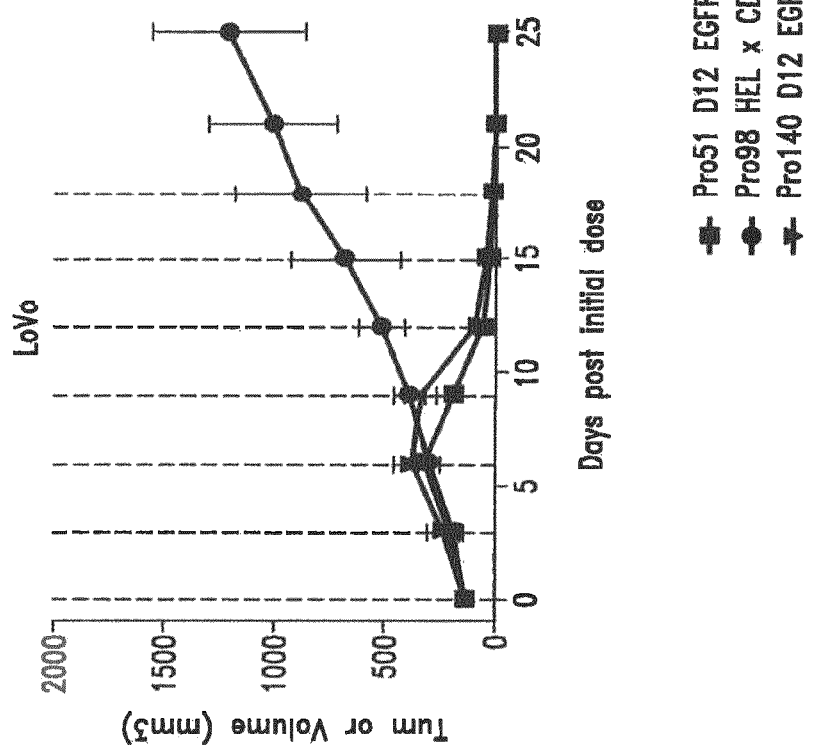
Figure 29:
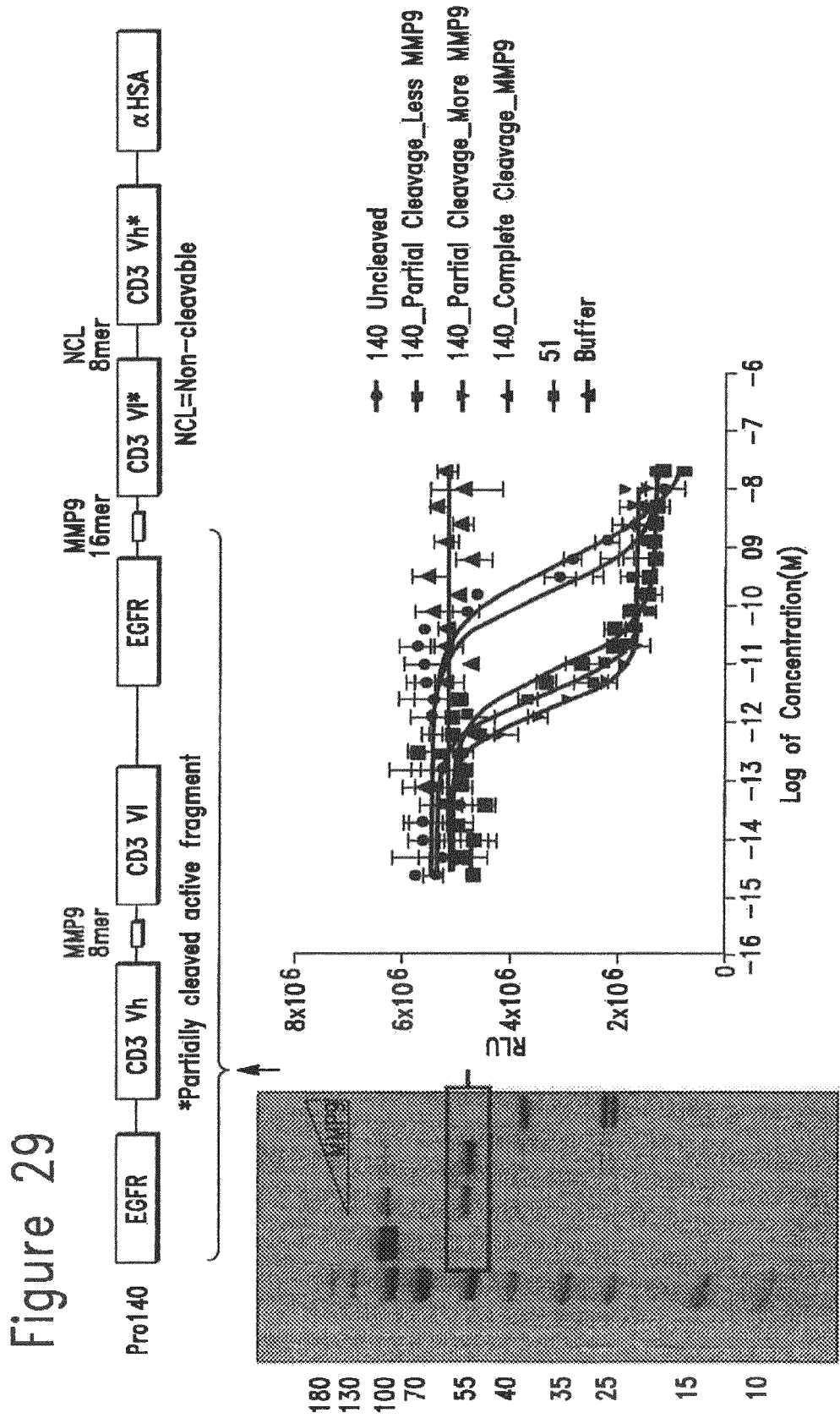
FIG. 29 depicts that due to the cleavage site in the constrained Fv, several different fragments can be generated: a partially cleaved fragment and the fully cleaved fragment. Surprisingly, the partially cleaved format is more active than the fully cleaved format, leading to the generation of Format 2.
Figure 30:
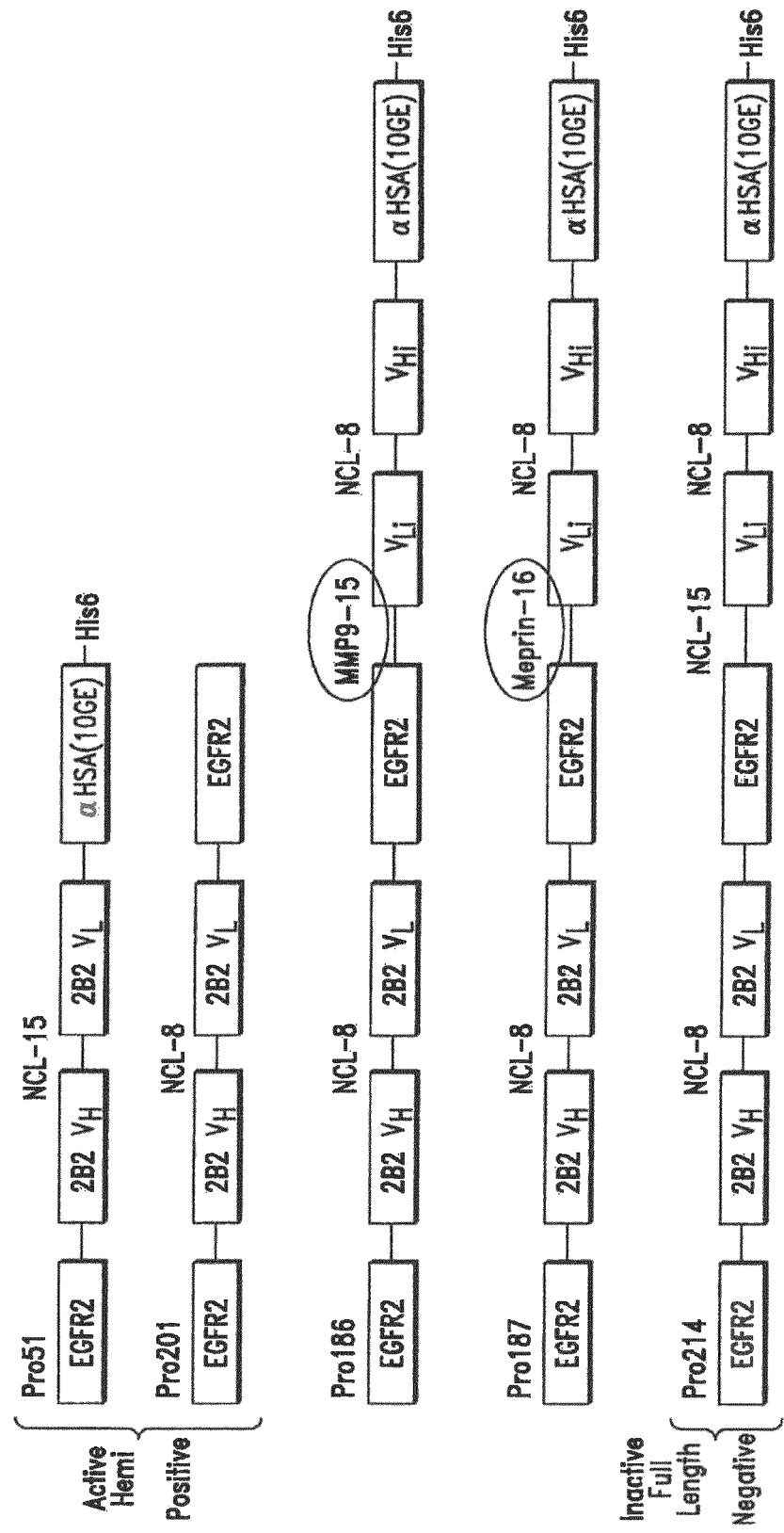
FIG. 30 shows a number of Format 2 schematics, all of which use sdABD-EGFR targeting domains, although as outlined herein and listed in the sequences, sdABDs to other TTAs can be used. Pro51 and Pro201 are positive controls (in an active "hemi" and active dimer configurations, respectively), and Pro214 is a full length negative control, as there is no cleavage site.
Figure 31:
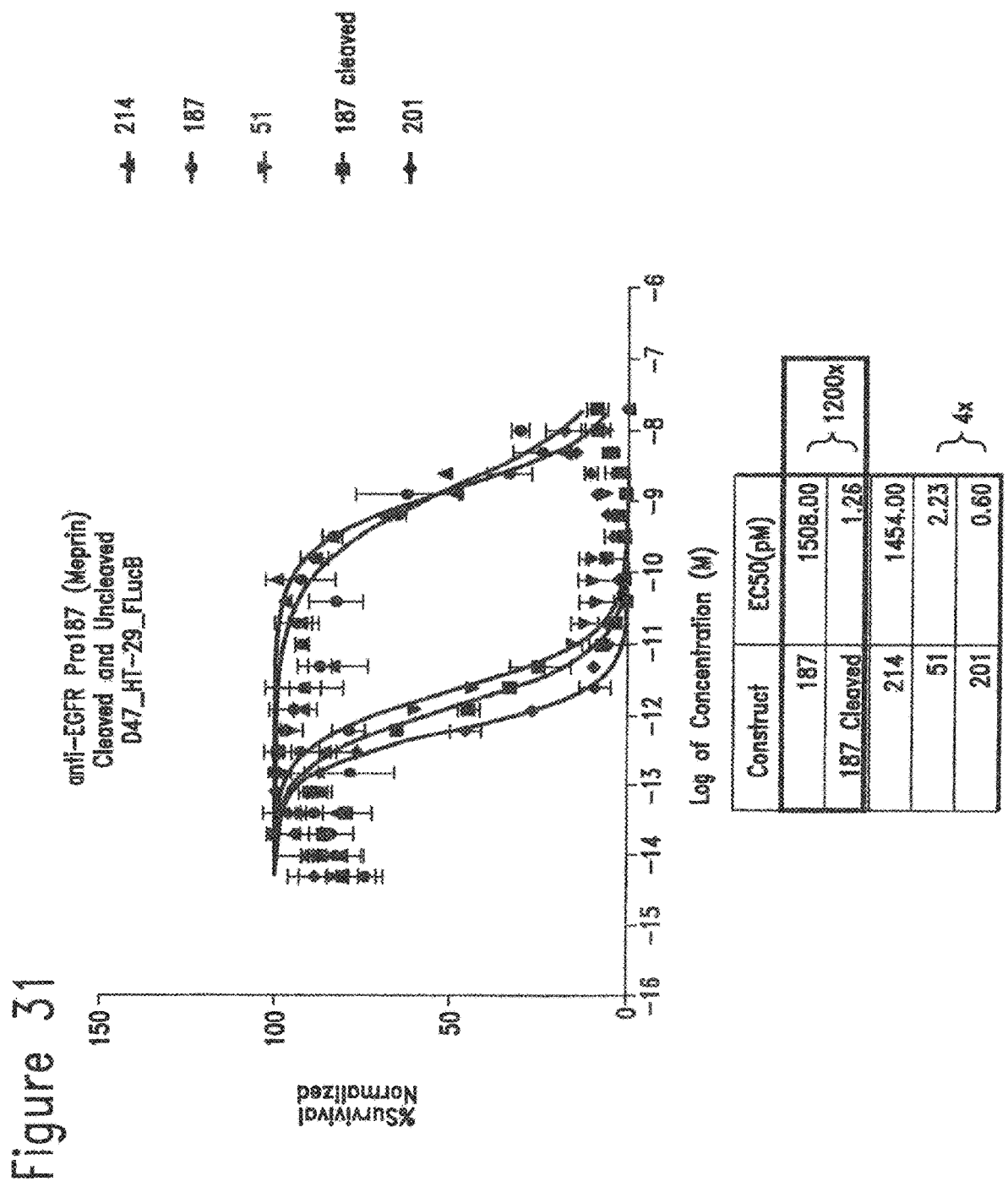
FIG. 31 shows the TDCC activity of Format 2 construct Pro187, which uses an meprin cleavage site. Pro187 in the TDCC assay was 1200-fold more active when added pre-cleaved than when added uncleaved. The pre-cleaved Pro187 demonstrated activity that fell between the positive controls Pro51 and Pro201. The uncleaved Pro187 demonstrated activity similar to Pro214, which does not contain a protease cleavable linker.
Figure 32:
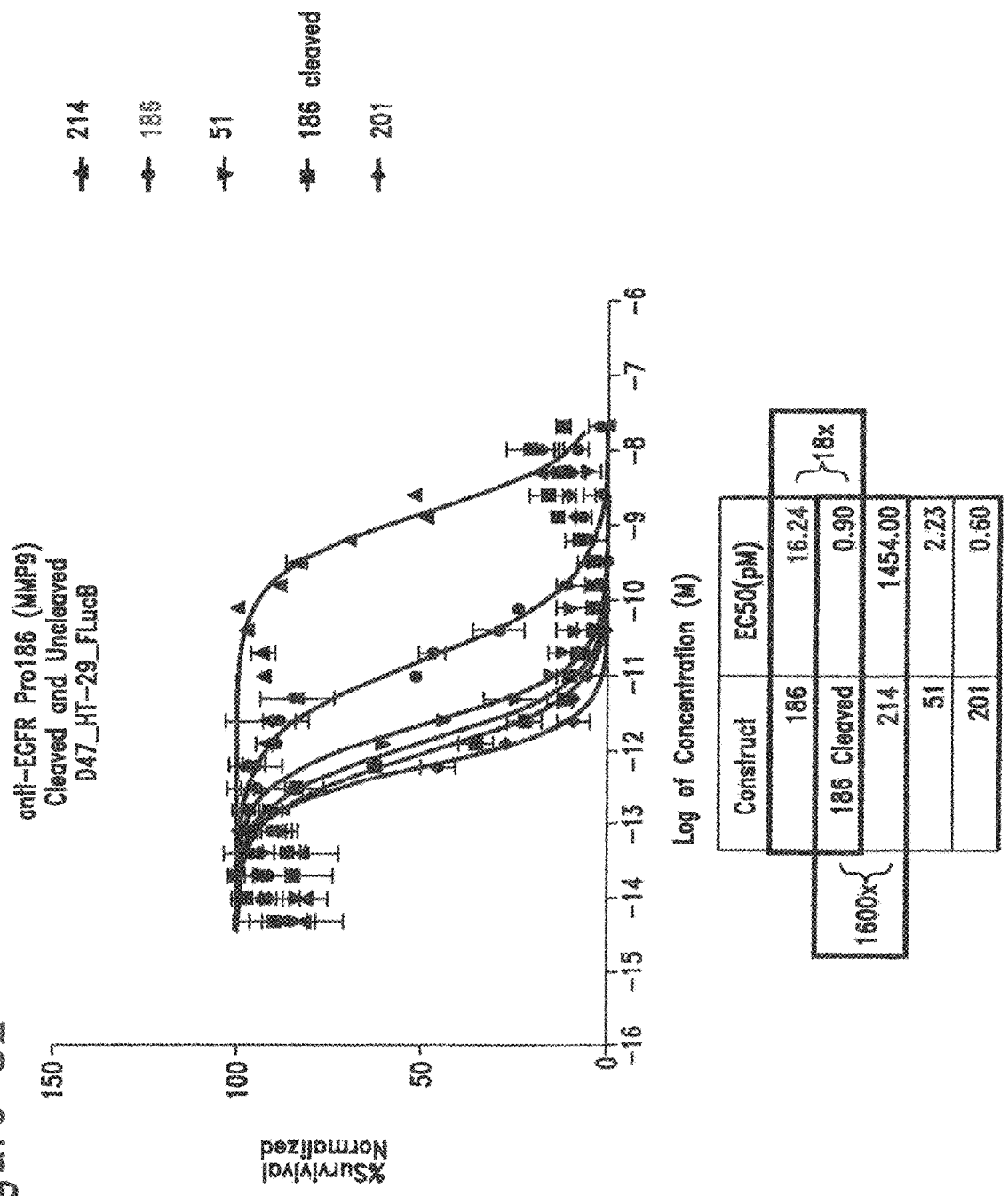
FIG. 32 shows the TDCC activity of Format 2 construct Pro186, which uses n MMP9 cleavage site. Pro186 in the TDCC assay was 18-fold more active when added pre-cleaved than when added uncleaved. The pre-cleaved Pro186 demonstrated activity that fell between the positive controls Pro51 and Pro201. The uncleaved Pro186 demonstrated more activity than Pro214, which does not contain a protease cleavable linker, likely due to MMP activity generated by the cells during the 48 hour assay period.
Figure 33:
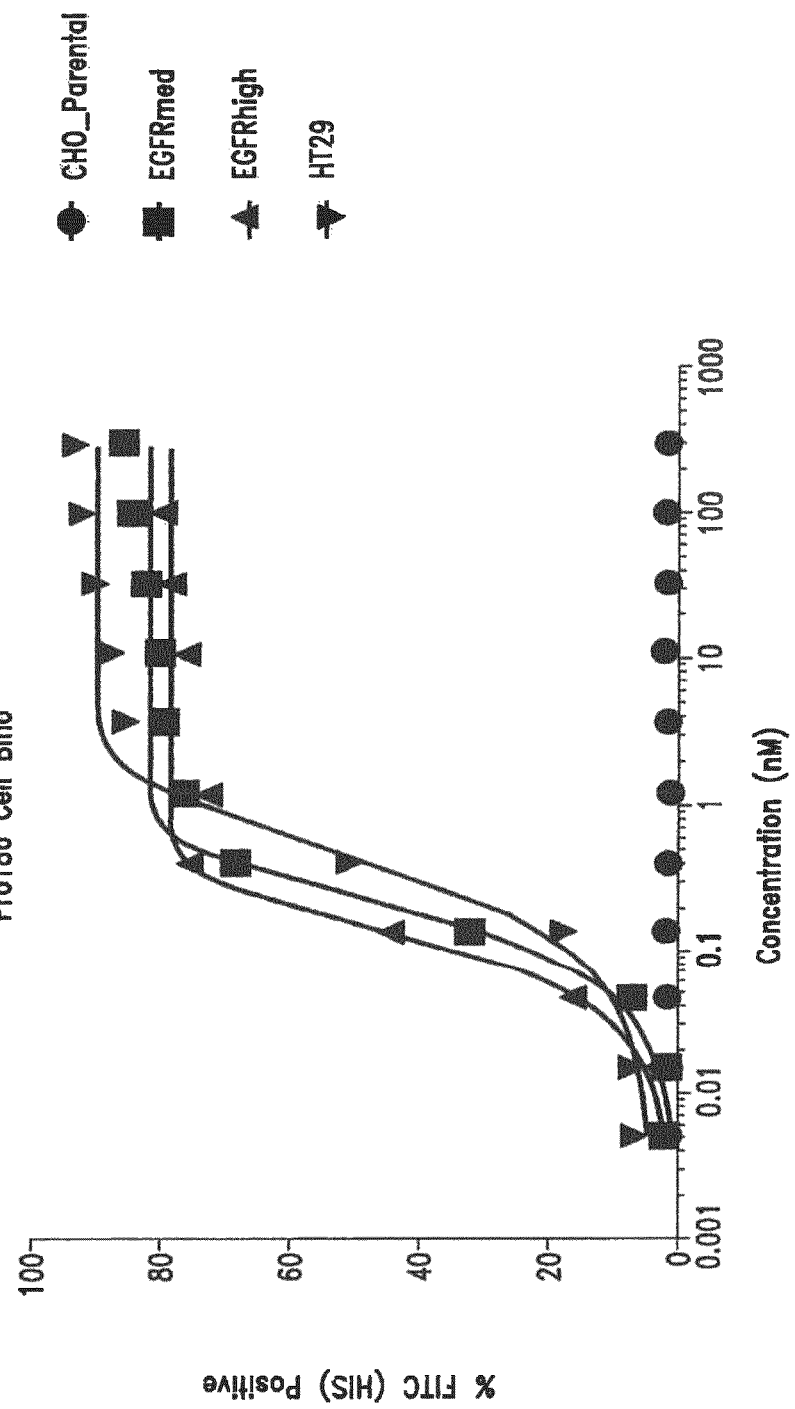
FIG. 33 depicts that the Pro186 construct binds to cells that have different levels of EGFR receptors, but does not bind to CHO cells not expressing EGFR on the cell surface. Pro186 saturates cells expressing differing levels of EGFR at similar COBRA concentrations.
Figure 34:
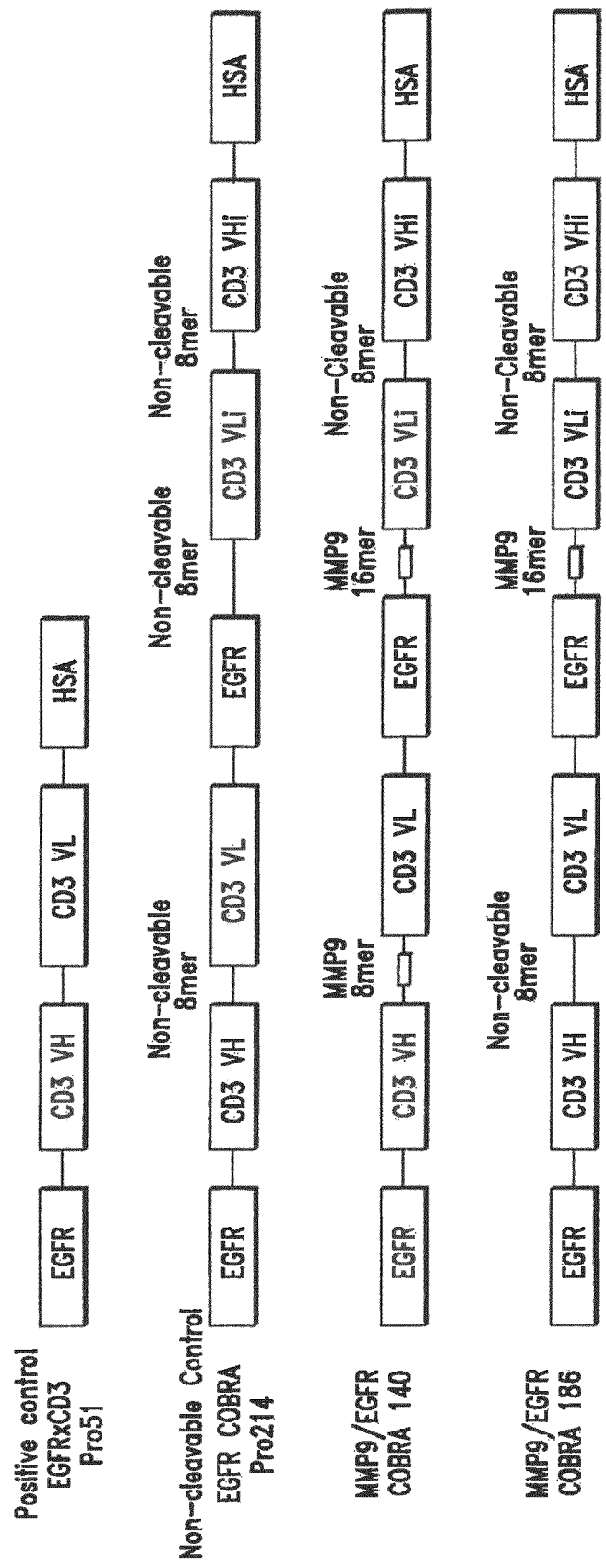
FIG. 34 shows the schematics of Format 2 constructs used in the in vivo studies of FIG. 35, all of which use sdABD-EGFR targeting domains.
Figure 35:
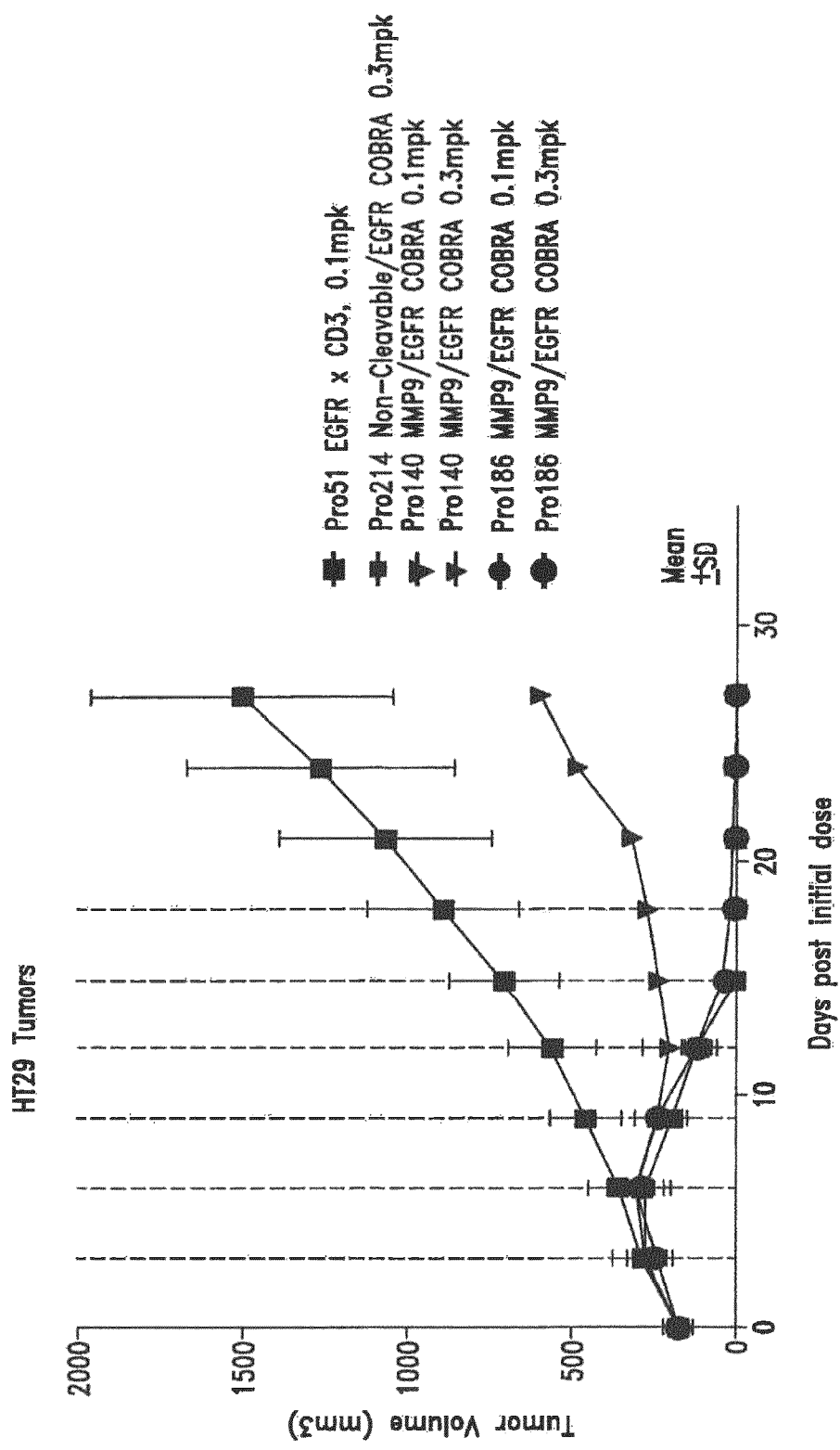
FIG. 35 shows that the Format 2 construct Pro186 is highly efficacious at both dose levels, and better than the Format 1 construct Pro140 at the lower dose.

In some embodiments, the pro-drug constructs of the invention utilize a single TTA binding domain, such as generally depicted in FIG. 3A, as pairs of sdABD-TTAs, and FIG. 4, as a "format 4" configuration. FIG. 4 shows the use of a single anti-EGFR ABD, although other TTA binding domains can be used.

In some embodiments, particularly in the Format 1 and Format 2 constructs, the pro-drug constructs of the invention utilize two TTA ABDs, again preferably in the sdABD-TTA format. When dual targeting domains are used, they can bind to the same epitope of the same TTA. For example, as discussed herein, many of the constructs herein utilize two identical targeting domains. In some embodiments, two targeting domains can be used that bind to different epitopes of the same TTA, for example as shown in FIG. 5, the two EGFR sdABDs bind to different epitopes on human EGFR. In some embodiments, the two targeting domains bind to different TTAs, see for example Figure.

Polypeptide constructs contemplated herein include at least one antigen binding domain, wherein the antigen binding domain binds to at least one target antigen. In some embodiments, the target antigen binding domains specifically bind to a cell surface molecule. In some embodiments, the target antigen binding domains specifically bind to a tumor antigen. In some embodiments, the target antigen binding domains specifically and independently bind to a tumor target antigen ("TTA") selected from at least one of EpCAM, EGFR, HER-2, HER-3, cMet, LyPD3, B7H3, CEA, Trop2 and FOLR1.

(a) EGFR sdABDs

As shown in FIG. 5, there are a number of particularly useful sdABDs that binding to human EGFR, referred to herein as "sdABD-EGFR" or "EGFRABDs".

In one useful embodiment, the sdABD-EGFR1 has a sdCDR1 with SEQ ID NO:10, a sdCDR2 with SEQ ID NO:11 and a sdCDR3 with SEQ ID NO:12. In some cases, the sdABD-EGFR has SEQ ID NO:9.

In one useful embodiment, the sdABD-EGFR2a has a sdCDR1 with SEQ ID NO:14, a sdCDR2 with SEQ ID NO:15 and a sdCDR3 with SEQ ID NO:16. In some cases, the sdABD-EGFR has SEQ ID NO:13.

In one useful embodiment, the sdABD-EGFR2d has a sdCDR1 with SEQ ID NO:18, a sdCDR2 with SEQ ID NO:19 and a sdCDR3 with SEQ ID NO:20. In some cases, the sdABD-EGFR has SEQ ID NO:17.

(b) EpCAM sdABDs

As shown in FIG. 5, there are a number of particularly useful sdABDs that binding to human EpCAM, referred to herein as "sdABD-EpCAM" or "EpCAMABDs".

In one useful embodiment, the sdABD-EpCAM h13 has a sdCDR1 with SEQ ID NO:62, a sdCDR2 with SEQ ID NO:63, a sdCDR3 with SEQ ID NO:64. In some cases, the sdABD-EpCAM has SEQ ID NO:61.

In one useful embodiment, the sdABD-EpCAM h23 has a sdCDR1 with SEQ ID NO:66, a sdCDR2 with SEQ ID NO:67, a sdCDR3 with SEQ ID NO:68. IN some cases, the sdABD-EpCAM has SEQ ID NO:65.

In one useful embodiment, the sdABD-EpCAM hVIB665 has a sdCDR1 with SEQ ID NO:70, a sdCDR2 with SEQ ID NO:71, a sdCDR3 with SEQ ID NO:72. IN some cases, the sdABD-EpCAM has SEQ ID NO:69. It should be noted that in contrast to the h13 and h23 EpCAM sdABDs, hVIB665 (also referred to as "acEpCAM hVIB665") binds to both the cleaved and uncleaved form of EpCAM (which is known to undergo a cleavage in vivo).

In one useful embodiment, the sdABD-EpCAM hVIB666 has a sdCDR1 with SEQ ID NO:74, a sdCDR2 with SEQ ID NO:75, a sdCDR3 with SEQ ID NO:76. IN some cases, the sdABD-EpCAM has SEQ ID NO:73. It should be noted that in contrast to the h13 and h23 EpCAM sdABDs, hVIB666 (also referred to as "acEpCAM hVIB666") binds to both the cleaved and uncleaved form of EpCAM (which is known to undergo a cleavage in vivo).

(c) B7H3 sdABDs

As shown in FIG. 5, there are a number of particularly useful sdABDs that binding to human B7H3, referred to herein as "sdABD-B7H3" or "B7H3-ABDs".

In one useful embodiment, the sdABD-B7H3 hF7 has a sdCDR1 with SEQ ID NO:34, a sdCDR2 with SEQ ID NO:35, a sdCDR3 with SEQ ID NO:36. IN some cases, the sdABD-B7H3 has SEQ ID NO:33.

In one useful embodiment, the sdABD-B7H3 hF12 has a sdCDR1 with SEQ ID NO:38, a sdCDR2 with SEQ ID NO:39, a sdCDR3 with SEQ ID NO:40. IN some cases, the sdABD-B7H3 has SEQ ID NO:37.

In one useful embodiment, the sdABD-B7H3 hF12 (N57Q) has a sdCDR1 with SEQ ID NO:42, a sdCDR2 with SEQ ID NO:43, a sdCDR3 with SEQ ID NO:44. IN some cases, the sdABD-B7H3 has SEQ ID NO:41. In contrast to the hF7 and hF12 B7H3 sdABDs, the amino acid substitution N57Q removes a glycosylation site.

In one useful embodiment, the sdABD-B7H3 HF12 (N57E) has a sdCDR1 with SEQ ID NO:46, a sdCDR2 with SEQ ID NO:47, and a sdCDR3 with SEQ ID NO:48. IN some cases, the sdABD-B7H3 has SEQ ID NO:45. In contrast to the hF7 and hF12 B7H3 sdABDs, the amino acid substitution N57E removes a glycosylation site.

In one useful embodiment, the sdABD-B7H3 hF12 (N57D) has a sdCDR1 with SEQ ID NO:50, a sdCDR2 with SEQ ID NO:51, a sdCDR3 with SEQ ID NO:52. IN some cases, the sdABD-B7H3 has SEQ ID NO:49. In contrast to the hF7 and hF12 B7H3 sdABDs, the amino acid substitution N57D removes a glycosylation site.

In one useful embodiment, the sdABD-B7H3 hF12 (S59A) has a sdCDR1 with SEQ ID NO:54, a sdCDR2 with SEQ ID NO:55, a sdCDR3 with SEQ ID NO:56. IN some cases, the sdABD-B7H3 has SEQ ID NO:53. In contrast to the hF7 and hF12 B7H3 sdABDs, the amino acid substitution S59A removes a glycosylation site.

In one useful embodiment, the sdABD-B7H3 hF12 (S59Y) has a sdCDR1 with SEQ ID NO:58, a sdCDR2 with SEQ ID NO:59, a sdCDR3 with SEQ ID NO:60. IN some cases, the sdABD-B7H3 has SEQ ID NO:57. In contrast to the hF7 and hF12 B7H3 sdABDs, the amino acid substitution NS59Y removes a glycosylation site.

(d) FOLR1 sdABDs

As shown in FIG. 5, there are a number of particularly useful sdABDs that binding to human FOLR1, referred to herein as "sdABD-FOLR1" or "FOLR1-ABDs".

In one useful embodiment, the sdABD-FOLR1 h77-2 has a sdCDR1 with SEQ ID NO:22, a sdCDR2 with SEQ ID NO:23, a sdCDR3 with SEQ ID NO:24. IN some cases, the sdABD-FOLR1 has SEQ ID NO:21.

In one useful embodiment, the sdABD-FOLR1 h59.3 has a sdCDR1 with SEQ ID NO:26, a sdCDR2 with SEQ ID NO:27, a sdCDR3 with SEQ ID NO:28. IN some cases, the sdABD-FOLR1 has SEQ ID NO:25.

In one useful embodiment, the sdABD-FOLR1 h22-4 has a sdCDR1 with SEQ ID NO:30, a sdCDR2 with SEQ ID NO:31, a sdCDR3 with SEQ ID NO:32. IN some cases, the sdABD-FOLR1 has SEQ ID NO:29.

(e) Trop2 sdABDs

As shown in FIG. 5, there are a number of particularly useful sdABDs that binding to human Trop2, referred to herein as "sdABD-Trop2" or "Trop2-ABDs".

In one useful embodiment, the sdABD-Trop2 hVIB557 has a sdCDR1 with SEQ ID NO:78, a sdCDR2 with SEQ ID NO:79, a sdCDR3 with SEQ ID NO:80. IN some cases, the sdABD-Trop2 has SEQ ID NO:77.

In one useful embodiment, the sdABD-Trop2 hVIB565 has a sdCDR1 with SEQ ID NO:82, a sdCDR2 with SEQ ID NO:83, a sdCDR3 with SEQ ID NO:84. IN some cases, the sdABD-Trop2 has SEQ ID NO:81.

In one useful embodiment, the sdABD-Trop2 hVIB575 has a sdCDR1 with SEQ ID NO:86, a sdCDR2 with SEQ ID NO:87, a sdCDR3 with SEQ ID NO:88. IN some cases, the sdABD-Trop2 has SEQ ID NO:85.

In one useful embodiment, the sdABD-Trop2 hVIB578 has a sdCDR1 with SEQ ID NO:90, a sdCDR2 with SEQ ID NO:91, a sdCDR3 with SEQ ID NO:92. IN some cases, the sdABD-Trop2 has SEQ ID NO:89.

In one useful embodiment, the sdABD-Trop2 hVIB609 has a sdCDR1 with SEQ ID NO:94, a sdCDR2 with SEQ ID NO:95, a sdCDR3 with SEQ ID NO:96. IN some cases, the sdABD-Trop2 has SEQ ID NO:93.

In one useful embodiment, the sdABD-Trop2 hVIB619 has a sdCDR1 with SEQ ID NO:98, a sdCDR2 with SEQ ID NO:99, a sdCDR3 with SEQ ID NO:100. IN some cases, the sdABD-Trop2 has SEQ ID NO:97.

(f) CA9 sdABDs

As shown in FIG. 5, there are a number of particularly useful sdABDs that binding to human CA9, referred to herein as "sdABD-CA9" or "CA9-ABDs".

In one useful embodiment, the sdABD-CA9 hVIB456 has a sdCDR1 with SEQ ID NO:102, a sdCDR2 with SEQ ID NO:103, a sdCDR3 with SEQ ID NO:104. IN some cases, the sdABD-Trop2 has SEQ ID NO:101.

In one useful embodiment, the sdABD-CA9 hVIB476 has a sdCDR1 with SEQ ID NO:106, a sdCDR2 with SEQ ID NO:107, a sdCDR3 with SEQ ID NO:108. IN some cases, the sdABD-Trop2 has SEQ ID NO:105.

In one useful embodiment, the sdABD-CA9 hVIB407 has a sdCDR1 with SEQ ID NO:110, a sdCDR2 with SEQ ID NO:111, a sdCDR3 with SEQ ID NO:112. IN some cases, the sdABD-Trop2 has SEQ ID NO:109.

In one useful embodiment, the sdABD-CA9 hVIB445 has a sdCDR1 with SEQ ID NO:114, a sdCDR2 with SEQ ID NO:115, a sdCDR3 with SEQ ID NO:116. IN some cases, the sdABD-Trop2 has SEQ ID NO:113.

In some embodiments, the protein prior to cleavage of the protease cleavage domain is less than about 100 kDa. In some embodiments, the protein after cleavage of the protease cleavage domain is about 25 to about 75 kDa. In some embodiments, the protein prior to protease cleavage has a size that is above the renal threshold for first-pass clearance. In some embodiments, the protein prior to protease cleavage has an elimination half-time of at least about 50 hours. In some embodiments, the protein prior to protease cleavage has an elimination half-time of at least about 100 hours. In some embodiments, the protein has increased tissue penetration as compared to an IgG to the same target antigen. In some embodiments, the protein has increased tissue distribution as compared to an IgG to the same target antigen.

C. Half Life Extension Domains

The MCE proteins of the invention (again, also referred to herein as "COBRA™" proteins or constructs) optionally include half-life extension domains. Such domains are contemplated to include but are not limited to HSA binding domains, Fc domains, small molecules, and other half-life extension domains known in the art.

Human serum albumin (HSA) (molecular mass ~67 kDa) is the most abundant protein in plasma, present at about 50 mg/ml (600 uM), and has a half-life of around 20 days in humans. HSA serves to maintain plasma pH, contributes to colloidal blood pressure, functions as carrier of many metabolites and fatty acids, and serves as a major drug transport protein in plasma.

Noncovalent association with albumin extends the elimination half-time of short lived proteins. For example, a recombinant fusion of an albumin binding domain to a Fab fragment resulted in a reduced in vivo clearance of 25- and 58-fold and a half-life extension of 26- and 37-fold when administered intravenously to mice and rabbits respectively as compared to the administration of the Fab fragment alone. In another example, when insulin is acylated with fatty acids to promote association with albumin, a protracted effect was observed when injected subcutaneously in rabbits or pigs. Together, these studies demonstrate a linkage between albumin binding and prolonged action.

In one aspect, the antigen-binding proteins described herein comprise a half-life extension domain, for example a domain which specifically binds to HSA. In other embodiments, the HSA binding domain is a peptide. In further embodiments, the HSA binding domain is a small molecule. It is contemplated that the HSA binding domain of an antigen binding protein is fairly small and no more than 25 kD, no more than 20 kD, no more than 15 kD, or no more than 10 kD in some embodiments. In certain instances, the HSA binding domain is 5 kD or less if it is a peptide or small molecule.

In many embodiments, the half-life extension domain is a single domain antigen binding domain from a single domain antibody that binds to HSA. This domain is generally referred to herein as "sdABD" to human HSA (sdABD-HSA), or alternatively "sdABD(½)", to distinguish these binding domains from the sdABDs to TTAs. A particularly useful sdABD(½) is shown in FIG. 5.

The half-life extension domain of an antigen binding protein provides for altered pharmacodynamics and pharmacokinetics of the antigen binding protein itself. As above, the half-life extension domain extends the elimination half-time. The half-life extension domain also alters pharmacodynamic properties including alteration of tissue distribution, penetration, and diffusion of the antigen-binding protein. In some embodiments, the half-life extension domain provides for improved tissue (including tumor) targeting, tissue penetration, tissue distribution, diffusion within the tissue, and enhanced efficacy as compared with a protein without a half-life extension binding domain. In one embodiment, therapeutic methods effectively and efficiently utilize a reduced amount of the antigen-binding protein, resulting in reduced side effects, such as reduced non-tumor cell cytotoxicity.

Further, characteristics of the half-life extension domain, for example a HSA binding domain, include the binding affinity of the HSA binding domain for HSA. Affinity of said HSA binding domain can be selected so as to target a specific elimination half-time in a particular polypeptide construct. Thus, in some embodiments, the HSA binding domain has a high binding affinity. In other embodiments, the HSA binding domain has a medium binding affinity. In yet other embodiments, the HSA binding domain has a low or marginal binding affinity. Exemplary binding affinities include KD concentrations at 10 nM or less (high), between 10 nM and 100 nM (medium), and greater than 100 nM (low). As above, binding affinities to HSA are determined by known methods such as Surface Plasmon Resonance (SPR).

D. Protease Cleavage Sites

The protein compositions of the invention, and particularly the prodrug constructs, include one or more protease cleavage sites, generally resident in cleavable linkers, as outlined herein.

As described herein, the prodrug constructs of the invention include at least one protease cleavage site comprising an amino acid sequence that is cleaved by at least one protease. In some cases, the MCE proteins described herein comprise 1, 2, 3, 4, 5, 6, 7, 8, 9, 10, 11, 12, 13, 14, 15, 16, 17, 18, 19, 20, or more protease cleavage sites that are cleaved by at least one protease. As is more fully discussed herein, when more than one protease cleavage site is used in a prodrug construction, they can be the same (e.g. multiple sites that are cleaved by a single protease) or different (two or more cleavage sites are cleaved by at least two different proteases). As will be appreciated by those in the art, constructs containing three or more protease cleavage sites can utilize one, two, three, etc.; e.g. some constructs can utilize three sites for two different proteases, etc.

The amino acid sequence of the protease cleavage site will depend on the protease that is targeted. As is known in the art, there are a number of human proteases that are found in the body and can be associated with disease states.

Proteases are known to be secreted by some diseased cells and tissues, for example tumor or cancer cells, creating a microenvironment that is rich in proteases or a protease-rich microenvironment. In some cases, the blood of a subject is rich in proteases. In some cases, cells surrounding the tumor secrete proteases into the tumor microenvironment. Cells surrounding the tumor secreting proteases include but are not limited to the tumor stromal cells, myofibroblasts, blood cells, mast cells, B cells, NK cells, regulatory T cells, macrophages, cytotoxic T lymphocytes, dendritic cells, mesenchymal stem cells, polymorphonuclear cells, and other cells. In some cases, proteases are present in the blood of a subject, for example proteases that target amino acid sequences found in microbial peptides. This feature allows for targeted therapeutics such as antigen-binding proteins to have additional specificity because T cells will not be bound by the antigen binding protein except in the protease rich microenvironment of the targeted cells or tissue.

Proteases are proteins that cleave proteins, in some cases, in a sequence-specific manner. Proteases include but are not limited to serine proteases, cysteine proteases, aspartate proteases, threonine proteases, glutamic acid proteases, metalloproteases, asparagine peptide lyases, serum proteases, Cathepsins (e.g. Cathepsin B, Cathepsin C, Cathepsin D, Cathepsin E, Cathepsin K, Cathepsin L, CathepsinS), kallikreins, hK1, hK10, hK15, KLK7, GranzymeB, plasmin, collagenase, Type IV collagenase, stromelysin, factor XA, chymotrypsin-like protease, trypsin-like protease, elastase-like protease, subtilisin-like protease, actinidain, bromelain, calpain, Caspases (e.g. Caspase-3), Mir1-CP, papain, HIV-1 protease, HSV protease, CMV protease, chymosin, renin, pepsin, matriptase, legumain, plasmepsin, nepenthesin, metalloexopeptidases, metalloendopeptidases, matrix metalloproteases (MMP), MMP1, MMP2, MMP3, MMP8, MMP9, MMP13, MMP11, MMP14, meprin, urokinase plasminogen activator (uPA), enterokinase, prostate-specific antigen (PSA, hK3), interleukin-1β converting enzyme, thrombin, FAP (FAP-α), dipeptidyl peptidase, and dipeptidyl peptidase IV (DPPIV/CD26).

Some suitable proteases and protease cleavage sequences are shown in FIG. 5 and FIG. 6.

E. Linkers

As is discussed herein, the different domains of the invention are generally linked together using amino acid linkers, which can confer functionality as well, including flexibility or inflexibility (e.g. steric constraint) as well as the ability to be cleaved using an in situ protease. These linkers can be classified in a number of ways.

The invention provides "domain linkers", which are used to join two or more domains (e.g. a VH and a VL, a target tumor antigen binding domain (TTABD, sometimes also referred to herein as "aTTA" (for "anti-TTA") to a VH or VL, a half life extension domain to another component, etc. Domain linkers can be non-cleavable (NCL), cleavable ("CL"), constrained and cleavable (CCL) and constrained and non-cleavable (CNCL), for example.

1. Non-Cleavable Linkers

In some embodiments, the domain linker is non-cleavable. Generally, these can be one of two types: non-cleavable and flexible, allowing for the components "upstream" and "downstream" of the linker in the constructs to intramolecularly self-assemble in certain ways; or non-cleavable and constrained, where the two components separated by the linker are not able to intramolecularly self-assemble. It should be noted, however, that in the latter case, while the two component domains that are separated by the non-cleavable constrained linker do not intramolecularly self-assemble, other intramolecular components will self-assemble to form the pseudo Fv domains.

(i) Non-Cleavable but Flexible Linkers

In this embodiment, the linker is used to join domains to preserve the functionality of the domains, generally through longer, flexible domains that are not cleaved by in situ proteases in a patient. Examples of internal, non-cleavable linkers suitable for linking the domains in the polypeptides of the invention include but are not limited to (GS)n, (GGS)n, (GGGS)n, (GGSG)n, (GGSGG)n, or (GGGGS)n, wherein n is 1, 2, 3, 4, 5, 6, 7, 8, 9, or 10. In some embodiments the length of the linker can be about 15 amino acids.

(ii) Non-Cleavable and Constrained Linkers

In some cases, the linkers do not contain a cleavage site and are also too short to allow the protein domains separated by the linker to intramolecularly self-assemble, and are "constrained non-cleavable linkers" or "CNCLs". For example, in Pro186, an active VH and an active VL are separated by 8 amino acids (an "8mer") that does not allow the VH and VL to self-assemble into an active antigen binding domain. In some embodiments, the linker is still flexible; for example, (GGGS)n where n=2. In other embodiments, although generally less preferred, more rigid linkers can be used, such as those that include proline or bulky amino acids.

2. Cleavable Linkers

All of the prodrug constructs herein include at least one cleavable linker. Thus, in one embodiment, the domain linker is cleavable (CL), sometimes referred to herein as a "protease cleavage domain" ("PCD"). In this embodiment, the CL contains a protease cleavage site, as outlined herein and as depicted in FIG. 5 and FIG. 6. In some cases, the CL contains just the protease cleavage site. Optionally, depending on the length of the cleavage recognition site, there can be an extra few linking amino acids at either or both of the N- or C-terminal end of the CL; for example, there may be from 1, 2, 3, 4 or 5 amino acids on either or both of the N- and C-termini of the cleavage site. Thus, cleavable linkers can also be constrained (e.g. 8mers) or flexible.

Of particular interest in the present invention are MMP9 cleavable linkers and Meprin cleavable linkers, particularly MMP9 constrained cleavable linkers and Meprin constrained cleavable linkers.

II. Domains of the Invention

The present invention provides a number of different formats for the prodrug polypeptides of the invention. The present invention provides constrained Fv domains and constrained pseudo Fv domains. Additionally, the present invention provides multivalent conditionally effective ("MCE") proteins which contain two Fv domains but are non-isomerizing constructs. As outlined herein, these can be non-isomerizing cleavable formats or non-isomerizing non-cleavable formats, although every construct contains at least one protease cleavage domain.

Figure 36:
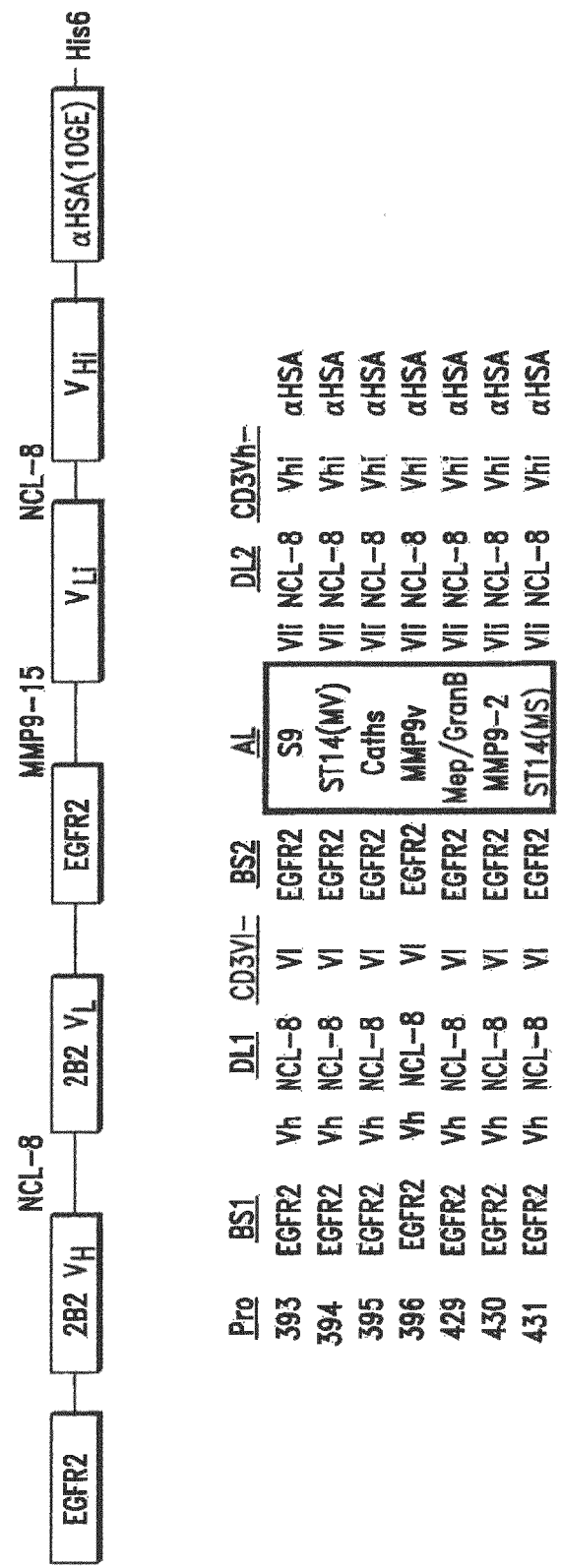
FIG. 36 depicts a number of Format 2 constructs based on Pro186 but with different protease cleavage sites. While all of these constructs utilize sdABD-EGFRs for both targeting domains, other sdABDs to different TTAs can be used, and can be the same or different. That is, both homo-targeting (both targeting sdABDs to the same TTA) or hetero-targeting (one sdABD to a first TTA and the other to a different TTA) can be done.

Importantly, while both of these domains (Fv domains and pseudo Fv domains) are referred to herein as "constrained", meaning that as discussed above and shown in FIG. 36, FIG. 37 and FIG. 38, only one of these needs to be constrained, although generally, when both linkers are constrained, the protein has better expression.

Those of skill in the art will appreciate that for Formats 1, 2 and 4, there are four possibilities for the N- to C-terminal order of the constrained and pseudo Fv domains of the invention (not showing the linkers): aVH-aVL and iVL-iVH, aVH-aVL and iVH-iVL, aVL-aVH and iVL-iVH, aVL-aVH and iVH-iVL. All four have been tested and all four have activity, although the first order, aVH-aVL and iVL-iVH, shows better expression than the other three. Thus while the description herein is generally shown in this aVH-aVL and iVL-iVH format, all disclosure herein includes the other orders for these domains as well.

Note that generally, the N to C-terminal order for the full length constructs of the invention is based on the aVH-aVL and iVL-iVH orientation.

Additionally, it is known in the art that there can be immunogenicity in humans originating from the C-terminal sequences of certain ABDs. Accordingly, in general, particularly when the C-terminus of the constructs terminates in an sdABD (for example, the sdABD-HSA domains of many of the constructs, a histidine tag (either His6 or His10) can be used. Many or most of the sequences herein were generated using His6 C-terminal tags for purification reasons, but these sequences can also be used to reduce immunogenicity in humans, as is shown by Holland et al., DOI 10.1007/s10875-013-9915-0 and WO2013/024059.

A. Constrained Fv Domains

The present invention provides constrained Fv domains, that comprise an active VH and an active VL domain that are covalently attached using a constrained linker (which, as outlined herein, can be cleavable (Format 1) or non-cleavable (Formats 2 and 4)). The constrained linker prevents intramolecular association between the aVH and aVL in the absence of cleavage. Thus, a constrained Fv domain general comprises a set of six CDRs contained within variable domains, wherein the vhCDR1, vhCDR2 and vhCDR3 of the VH bind human CD-3 and the vlCDR1, vCDR2 and vlCDR3 of the VL bind human CD-3, but in the prodrug format (e.g. uncleaved), the VH and VL are unable to sterically associate to form an active binding domain, preferring instead to pair intramolecularly with the pseudo Fv.

The constrained Fv domains can comprise active VH and active VL (aVH and aVL) or inactive VH and VL (iVH and iVL, in which case it is a constrained pseudo Fv domain) or combinations thereof as described herein.

As will be appreciated by those in the art, the order of the VH and VL in a constrained Fv domain can be either (N- to C-terminal) VH-linker-VL or VL-linker-VH.

As outlined herein, for Format 1 constructs, the constrained Fv domains can comprise a VH and a VL linked using a cleavable linker, in cases such as those shown in FIG. 5 and FIG. 6. In this embodiment, the constrained Fv domain has the structure (N- to C-terminus) vhFR1-vhCDR1-vhFR2-vhCDR2-vhFR3-vhCDR3-vhFR4-CCL-vlFR1-vlCDR1-vlFR2-vlCDR2-vlFR3-vlCDR3-vlFR4. In general, the constrained Fv domain contains active VH and VL domains (e.g. able to bind CD3 when associated) and thus has the structure (N- to C-terminus) vhFR1-avhCDR1-vhFR2-avhCDR2-vhFR3-avhCDR3-vhFR4-CCL-vlFR1-avlCDR1-vlFR2-avlCDR2-vlFR3-avlCDR3-vlFR4.

As outlined herein, for Format 2 constructs, the constrained Fv domains can comprise a VH and a VL linked using a non-cleavable linker. In this embodiment, the constrained Fv domain has the structure (N- to C-terminus) vhFR1-vhCDR1-vhFR2-vhCDR2-vhFR3-vhCDR3-vhFR4-CNCL-vlFR1-vlCDR1-vlFR2-vlCDR2-vlFR3-vlCDR3-vlFR4. In general, the constrained Fv domain contains active VH and VL domains (e.g. able to bind CD3 when associated) and thus has the structure (N- to C-terminus) vhFR1-avhCDR1-vhFR2-avhCDR2-vhFR3-avhCDR3-vhFR4-CNCL-vlFR1-avlCDR1-vlFR2-avlCDR2-vlFR3-avlCDR3-vlFR4.

Of particular use in the present invention are constrained non-cleavable Fv domains having an aVH having SEQ ID NO:142, an aVL having SEQ ID NO:126, and a domain linker having SEQ ID NO:233.

B. Constrained Pseudo Fv Domains

The present invention provides constrained pseudo Fv domains, comprising inactive or pseudo iVH and iVL domains that are covalently attached using a constrained linker (which, as outlined herein, can be cleavable or non-cleavable). The constrained linker prevents intramolecular association between the iVH and iVL in the absence of cleavage. Thus, a constrained pseudo Fv domain general comprises an iVH and an iVL with framework regions that allow association (when in a non-constrained format) of the iVH and iVL, although the resulting pseudo Fv domain does not bind to a human protein. iVH domains can assemble with aVL domains, and iVL domains can assemble with aVH domains, although the resulting structures do not bind to CD3.

The constrained pseudo Fv domains comprise inactive VH and VL (iVH and iVL).

As will be appreciated by those in the art, the order of the VH and VL in a constrained pseudo Fv domain can be either (N- to C-terminal) VH-linker-VL or VL-linker-VH.

As outlined herein, the constrained pseudo Fv domains can comprise a iVH and an iVL linked using a non-cleavable linker, as shown in Formats 1, 2 and 4, or with cleavable linkers, as shown in Format 3.

In general, the constrained Fv domain contains inert VH and VL domains (e.g. able to bind CD3 when associated) and thus has the structure (N- to C-terminus) vhFR1-ivlCDR1-vhFR2-ivlCDR2-vhFR3-ivlCDR3-vhFR4-CNCL-vlFR1-ivhCDR1-vlFR2-ivhCDR2-vlFR3-ivhCDR3-vlFR4.

Of particular use in the present invention are constrained non-cleavable pseudo Fv domains having an iVH having SEQ ID NO:146, SEQ ID NO:150 or SEQ ID NO:154, an iVL having SEQ ID NO:130, SEQ ID NO:134 or SEQ ID NO:138, and a domain linker having SEQ ID NO:233.

III. Formats of the Invention

As discussed herein, the pro-drug constructs of the invention can take on a number of different formats, including cleavable formats with dual TTA binding domains, non-cleavable formats with dual TTA binding domains (either of which can have the same TTA binding domains or different binding domains), and non-cleavable formats with a single targeting domain.

A. Cleavable Formats with Dual Targeting

The invention provides non-isomerizing cleavable formats of the "format 1" type in FIG. 1. In this embodiment, the constrained Fv domain comprise VH and VL domains that are linked using constrained cleavable linkers and the constrained pseudo Fv domain uses constrained non-cleavable linkers. For ease of discussion, both of these are referred to herein as "constrained", but as discussed above and shown in FIG. 37, FIG. 38 and FIG. 39, only one of these needs to be constrained, although generally, when both linkers are constrained, the protein has better expression.

All constructs in Format 1 (as well as the other formats) also have a cleavable linker (CL) that is cleaved by a human tumor protease.

The invention provides prodrug proteins, comprising, from N- to C-terminal, (sdABD-TTA1)-domain linker-constrained Fv domain-domain linker-(sdABD-TTA2)-CL-constrained pseudo Fv domain-domain linker-sdABD-HSA.

As will be appreciated by those in the art, the order of the VH and VL in either a constrained Fv domain or a constrained pseudo Fv domain can be either (N- to C-terminal) VH-linker-VL or VL-linker-VH.

Thus, in one embodiment, the prodrug protein comprises, from N- to C-terminal: (sdABD-TTA1)-domain linker-aVH-CCL-aVL-domain linker-(sdABD-TTA2)-CL-iVL-CNCL-iVH-domain linker-sdABD-HSA.

Thus, in one embodiment, the prodrug protein comprises, from N- to C-terminal: (sdABD-TTA1)-domain linker-aVH-CCL-aVL-domain linker-(sdABD-TTA2)-CL-iVH-CCL-iVL-domain linker-sdABD-HSA.

Thus, in one embodiment, the prodrug protein comprises, from N- to C-terminal: (sdABD-TTA1)-domain linker-aVL-CCL-aVH-domain linker-(sdABD-TTA2)-CL-iVL-CCL-iVH-domain linker-sdABD-HSA.

Thus, in one embodiment, the prodrug protein comprises, from N- to C-terminal: (sdABD-TTA1)-domain linker-aVL-CCL-aVH-domain linker-(sdABD-TTA2)-CL-iVH-CCL-iVL-domain linker-sdABD-HSA.

In some embodiments, the prodrug construct comprises sdABD(TTA1)-domain linker-aVH-CCL-aVL-domain linker-sdABD(TTA2)-CL-iVL-CNCL-iVH-NCL-sdABD (½). In this embodiment, the aVH, aVL, iVH and iVL have the sequences shown in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to the same TTA, which can be EGFR, EpCAM, FOLR1, Trop2, CA9 or B7H3, the sequences for which are depicted in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to different TTAs.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to EGFR and EpCAM, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to EGFR and FOLR1, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to EGFR and B7H3, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to EpCAM and FOLR1, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to EpCAM and B7H3, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to B7H3 and FOLR1, and the sdABD-TTAs have the sequences in FIG. 5.

In some embodiments, the prodrug construct comprises sdABD(TTA1)-domain linker-aVH-CCL-aVL-domain linker-sdABD(TTA2)-CL-iVL-CNCL-iVH-domain linker-sdABD(½). In this embodiment, the aVH, aVL, iVH, iVL have the sequences shown in FIG. 5. In this embodiment, the two targeting domains bind to the same TTA, which can be EGFR, FOLR1, B7H3, Trop2, CA9 or EpCAM, the sequences for which are depicted in FIG. 5, and the CCL and CL is selected from a linker that is cleaved by MMP9 or meprin, and the sdABD(½) has SEQ ID NO:117 or SEQ ID NO:121.

In Format 1, a preferred domain linker is SEQ ID NO:233 (which also serves as a preferred constrained non cleavable linker).

In Format 1, preferred constructs are Pro140 and Pro140b.

B. Non-Cleavable Formats

As shown in FIG. 2, the invention provides non-isomerizing non-cleavable formats. In this embodiment, it is understood that the "non-cleavable" applies only to the linkage of the constrained Fv domain, as there is the activating cleavage site in the prodrug construct. In this embodiment, the constrained Fv domain comprise VH and VL domains that are linked using constrained non-cleavable linkers and the constrained pseudo Fv domain uses constrained non-cleavable linkers.

As will be appreciated by those in the art, the order of the VH and VL in either a constrained Fv domain or a constrained pseudo Fv domain can be either (N- to C-terminal) VH-linker-VL or VL-linker-VH.

The invention provides prodrug proteins, comprising, from N- to C-terminal, sdABD(TTA1)-domain linker-constrained Fv domain-domain linker-sdABD(TTA2)-cleavable linker-constrained pseudo Fv domain-domain linker-sdABD-HSA.

As will be appreciated by those in the art, the order of the VH and VL in either a constrained Fv domain or a constrained pseudo Fv domain can be either (N- to C-terminal) VH-linker-VL or VL-linker-VH.

Thus, in one embodiment, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA.

Thus, in one embodiment, the prodrug protein comprises, from N- to C-terminal: (sdABD-TTA1)-domain linker-aVH-CNCL-aVL-domain linker-(sdABD-TTA2)-CL-iVH-CNCL-iVL-domain linker-sdABD-HSA.

Thus, in one embodiment, the prodrug protein comprises, from N- to C-terminal: (sdABD-TTA1)-domain linker-aVL-CNCL-aVH-domain linker-(sdABD-TTA2)-CL-iVL-CNCL-iVH-domain linker-sdABD-HSA.

Thus, in one embodiment, the prodrug protein comprises, from N- to C-terminal: (sdABD-TTA1)-domain linker-aVL-CNCL-aVH-domain linker-(sdABD-TTA2)-CL-iVL-CNCL-iVL-domain linker-sdABD-HSA.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to the same TTA, which can be EGFR, EpCAM, FOLR1, Trop2, CA9 or B7H3, the sequences for which are depicted in FIG. 5.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to different TTAs.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to EGFR and EpCAM, and the sdABD-TTAs have the sequences in FIG. 5. In this embodiment, preferred combinations of EGFR and EpCAM include:

| cross | EGFR2 | EGFR2a | EGFR2d |
|---|---|---|---|
| EpCAM h13 | In either orientation | In either orientation | In either orientation |
| EpCAM h23 | In either orientation | In either orientation | In either orientation |
| EpCAM hVIB665 | In either orientation | In either orientation | In either orientation |
| EpCAM hVIB666 | In either orientation | In either orientation | In either orientation |

In this case, "either orientation" means that either the EpCAM sdABD is N-terminal to the EGFR sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to EGFR and FOLR1, and the sdABD-TTAs have the sequences in FIG. 5. In this embodiment, preferred combinations of EGFR and FOLR1 include:

| cross | EGFR2 | EGFR2a | EGFR2d |
|---|---|---|---|
| FOLR1h77-2 | In either orientation | In either orientation | In either orientation |
| FOLR1 h59.3 | In either orientation | In either orientation | In either orientation |
| FOLR h22-4 | In either orientation | In either orientation | In either orientation |

In this case, "either orientation" means that either the FOLR1 sdABD is N-terminal to the EGFR sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to EGFR and B7H3, and the sdABD-TTAs have the sequences in FIG. 5. In this embodiment, Preferred combinations of EGFR and B7H3 include:

| cross | EGFR2 | EGFR2a | EGFR2d |
|---|---|---|---|
| B7H3 hF7 | In either orientation | In either orientation | In either orientation |
| B7H3 hF12 | In either orientation | In either orientation | In either orientation |
| B7H3 hF12(N57Q) | In either orientation | In either orientation | In either orientation |
| B7H3 hF12(N57E) | In either orientation | In either orientation | In either orientation |
| B7H3 hF12(N57D) | In either orientation | In either orientation | In either orientation |
| B7H3 hF12(S59A) | In either orientation | In either orientation | In either orientation |
| B7H3 hF12(S59Y) | In either orientation | In either orientation | In either orientation |

In this case, "either orientation" means that either the B7H3 sdABD is N-terminal to the EGFR sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to EpCAM and FOLR1, and the sdABD-TTAs have the sequences in FIG. 5. In this embodiment, preferred combinations of EpCAM and FOLR1 include:

| cross | FOLR1h77-2 | FOLR1 h59.3 | FOLR h22-4 |
|---|---|---|---|
| EpCAM h13 | In either orientation | In either orientation | In either orientation |
| EpCAM h23 | In either orientation | In either orientation | In either orientation |
| EpCAM hVIB665 | In either orientation | In either orientation | In either orientation |
| EpCAM hVIB666 | In either orientation | In either orientation | In either orientation |

In this case, "either orientation" means that either the EpCAM sdABD is N-terminal to the FOLR1 sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to EpCAM and B7H3, and the sdABD-TTAs have the sequences in FIG. 5. In this embodiment, preferred combinations of EpCAM and B7H3 include:

| cross | EpCAM h13 | EpCAM h23 | EpCAM hVIB665 | EpCAM hVIB666 |
|---|---|---|---|---|
| B7H3 hF7 | In either orientation | In either orientation | In either orientation | In either orientation |
| B7H3 hF12 | In either orientation | In either orientation | In either orientation | In either orientation |
| B7H3 hF12(N57Q) | In either orientation | In either orientation | In either orientation | In either orientation |
| B7H3 hF12(N57E) | In either orientation | In either orientation | In either orientation | In either orientation |
| B7H3 hF12(N57D) | In either orientation | In either orientation | In either orientation | In either orientation |
| B7H3 hF12(S59A) | In either orientation | In either orientation | In either orientation | In either orientation |
| B7H3 hF12(S59Y) | In either orientation | In either orientation | In either orientation | In either orientation |

In this case, "either orientation" means that either the B7H3 sdABD is N-terminal to the EGFR sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to FOLR1 and B7H3, and the sdABD-TTAs have the sequences in FIG. 5. In this embodiment, preferred combinations of FOLR1 and B7H3 include:

| cross | FOLR1h77-2 | FOLR1 h59.3 | FOLR h22-4 |
|---|---|---|---|
| B7H3 hF7 | In either orientation | In either orientation | In either orientation |
| B7H3 hF12 | In either orientation | In either orientation | In either orientation |
| B7H3 hF12(N57Q) | In either orientation | In either orientation | In either orientation |
| B7H3 hF12(N57E) | In either orientation | In either orientation | In either orientation |
| B7H3 hF12(N57D) | In either orientation | In either orientation | In either orientation |
| B7H3 hF12(S59A) | In either orientation | In either orientation | In either orientation |
| B7H3 hF12(S59Y) | In either orientation | In either orientation | In either orientation |

In this case, "either orientation" means that either the B7H3 sdABD is N-terminal to the FOLR1 sdABD in the constructs of the invention or C-terminal to it.

In some embodiments, the prodrug protein comprises, from N- to C-terminal: (sdABD-TTA1)-domain linker-aVH-CNCL-aVL-domain linker-(sdABD-TTA2)-CL-iVL-CNCL-iVH-domain linker-sdABD-HSA. In this embodiment, the aVH, aVL, iVH, iVL have the sequences shown in FIG. 5. In this embodiment, the two targeting domains bind to the same TTA, which can be EGFR, FOLR1, B7H3, CA9, Trop2 or EpCAM, the sequences for which are depicted in FIG. 5, and the CCL and CL is selected from a linker that is cleaved by MMP9 or meprin, and the sdABD(½) has SEQ ID NO:117.

In Format 2, a preferred domain linker is SEQ ID NO:233 (which also serves as a preferred constrained non cleavable linker).

In Format 2, preferred dual targeting constructs (sometimes referred to herein as "hetero-COBRAs") include combinations that target EGFR and EpCAM, EGFR and Trop2, EGFR and FOLR1, EGFR and B7H3, EpCAM and Trop2, EpCAM and FOLR1, EpCAM and B7H3, Trop2 and FOLR1, Trop2 and B7H3, and FOLR1 and B7H3, as more fully described below.

In Format 2, embodiments of particular use include, but are not limited to, Pro186, Pro225, Pro226, Pro233, Pro262, Pro311, Pro312, Pro313, Pro356, Pro359, Pro364, Pro388, Pro448, Pro449, Pro450, Pro451, Pro495, Pro246, Pro254, Pro255, Pro256, Pro420, Pro421, Pro432, Pro479, Pro480, Pro187, Pro221, Pro222, Pro223, Pro224, Pro393, Pro394, Pro395, Pro396, Pro429, Pro430, Pro431, Pro601, Pro602, V3 and V4, Pro664, Pro665, Pro667, Pro694, Pro695, Pro565, Pro566, Pro567, Pro727, Pro728, Pro729, Pro730, Pro731, Pro676, Pro677, Pro678, Pro679, Pro808, Pro819, Pro621, Pro622, Pro640, Pro641, Pro642, Pro643, Pro744, Pro746, Pro638, Pro639, Pro396, Pro476, Pro706, Pro709, Pro470, Pro471, Pro551, Pro552, Pro623, Pro624, Pro698, Pro655, Pro656, Pro657, Pro658, Pro516, Pro517, Pro518 and Pro519.

C. Single TTA Constructs

As is shown in FIG. 4, "format 4" constructs are also included in the compositions of the invention, that are similar to Format 2 constructs but without a second TTA ABD. In this embodiment, it is understood that the "non-cleavable" applies only to the linkage of the constrained Fv domain, as there is the activating cleavage site in the prodrug construct. In this embodiment, the constrained Fv domain comprise VH and VL domains that are linked using constrained non-cleavable linkers and the constrained pseudo Fv domain uses constrained non-cleavable linkers.

As will be appreciated by those in the art, the order of the VH and VL in either a constrained Fv domain or a constrained pseudo Fv domain can be either (N- to C-terminal) VH-linker-VL or VL-linker-VH.

The invention provides prodrug proteins, comprising, from N- to C-terminal, sdABD(TTA)-domain linker-constrained Fv domain-cleavable linker-sdABD-HSA-constrained pseudo Fv domain. (Note that for all constructs for this format, the sdABD-HSA does not generally have a His6 tag, although it can be included).

As will be appreciated by those in the art, the order of the VH and VL in either a constrained Fv domain or a constrained pseudo Fv domain can be either (N- to C-terminal) VH-linker-VL or VL-linker-VH.

Thus, in one embodiment, the prodrug protein comprises, from N- to C-terminal: (sdABD-TTA)-domain linker-aVH-CNCL-aVL-CL-(sdABD-HSA)-domain linker-iVL-CNCL-iVH.

Thus, in one embodiment, the prodrug protein comprises, from N- to C-terminal: (sdABD-TTA)-domain linker-aVH-CNCL-aVL-CL-(sdABD-HSA)-domain linker-iVH-CNCL-iVL.

Thus, in one embodiment, the prodrug protein comprises, from N- to C-terminal: (sdABD-TTA)-domain linker-aVL-CNCL-aVH-CL-(sdABD-HSA)-domain linker-iVH-CNCL-iVL.

Thus, in one embodiment, the prodrug protein comprises, from N- to C-terminal: (sdABD-TTA)-domain linker-aVL-CNCL-aVH-CL-(sdABD-HSA)-domain linker-iVL-CNCL-iVH.

Thus, in one embodiment, the prodrug protein comprises, from N- to C-terminal: (sdABD-TTA)-domain linker-aVH-CNCL-aVL-CL-(sdABD-HSA)-domain linker-iVL-CNCL-iVH. In this embodiment, the aVH, aVL, iVH, iVL have the sequences shown in FIG. 5. In this embodiment, the targeting domain binds to a TTA which can be EGFR, EpCAM, FOLR1, Trop2, CA9 or B7H3, the sequences for which are depicted in FIG. 5.

In Format 4, a preferred domain linker is SEQ ID NO:233 (which also serves as a preferred constrained non cleavable linker).

In Format 4, a preferred sdABD-HSA is that of SEQ ID NO:121 or 117.

D. Two Protein Compositions

In some embodiments, the compositions of the invention comprise two different molecules, sometimes referred to as "hemi-COBRAs™", or "hemi-constructs", that in the absence of cleavage, intramolecularly associate to form pseudo-Fvs. In the presence of the protease, the cleavage sites are cleaved, releasing the inert variable domains, and the protein pair then forms an active antigen binding domain to CD3, as generally depicted in FIG. 3.

What is important in the design of the hemi-constructs is that the active variable domain and the sdABD-TTA remain together after cleavage, such that the two cleaved portions are held together by the tumor antigen receptor on the tumor surface and then can form an active anti-CD3 binding domain.

There are two different general Format 3 constructs, those wherein each member of the pair has a single sdABD-TTA (FIG. 3A) and those with two different sdABD-TTAs, each to a different TTA (FIG. 3B).

1. Hemi-COBRA™ Constructs with Single TTA Binding Domains (Format 3A)

In some embodiments, the first hemi-COBRA™ has, from N- to C-terminal, sdABD(TTA1)-domain linker-aVH-CL-iVL-domain linker-sdABD(½) and the second has sdABD(½)-domain linker-iVH-CL-aVL-domain linker-sdABD(TTA2). In this embodiment, the aVH, aVL, iVH, iVL and sdABD(½) have the sequences shown in FIG. 5, and the sdABD-TTAa bind to human EGFR, EpCAM, Trop2, CA9 FOLR1 and/or B7H3, and has a sequence depicted in FIG. 5.

2. Hemi-COBRA™ Constructs with Dual TTA ABDs

In some embodiments, the paired pro-drug constructs can have two sdABD-TTA binding domains per construct, as is shown in FIG. 3B. In this embodiments, the first member of the pair comprises, from N- to C-terminal, sdABD-TTA1-domain linker-sdABD-TTA2-domain linker-aVH-CL-iVL-domain linker-sdABD(HAS), and the second member comprises, from N- to C-terminal, sdABD-TTA1-domain linker-sdABD-TTA2-aVL-CL-iVH-domain linker-sdABD-HSA.

The two sdABD-TTAs on each member of the pair are different, but generally both members (hemi-COBRAs™) have the same two sdABD-TTAs, e.g. both have EGFR and FOLR1 or EGFR and B7H3, etc.

The two sdABD-TTAs are in some embodiments selected from the ones shown in FIG. 5.

IV. Methods of Making the Compositions of the Invention

The pro-drug compositions of the invention are made as will generally be appreciated by those in the art and outlined below.

The invention provides nucleic acid compositions that encode the pro-drug compositions of the invention. As will be appreciated by those in the art, the nucleic acid compositions will depend on the format of the pro-drug polypeptide(s). Thus, for example, when the format requires two amino acid sequences, such as the "format 3" constructs, two nucleic acid sequences can be incorporated into one or more expression vectors for expression. Similarly, prodrug constructs that are a single polypeptide (formats 1, 2 and 4), need a single nucleic acid in a single expression vector for production.

As is known in the art, the nucleic acids encoding the components of the invention can be incorporated into expression vectors as is known in the art, and depending on the host cells used to produce the prodrug compositions of the invention. Generally, the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells, 293 cells), finding use in many embodiments.

The prodrug compositions of the invention are made by culturing host cells comprising the expression vector(s) as is well known in the art. Once produced, traditional antibody purification steps are done, including an Protein A affinity chromatography step and/or an ion exchange chromatography step.

V. Formulation and Administration of the Pro-Drug Compositions of the Invention Formulations of the pro-drug compositions used in accordance with the present invention are prepared for storage by mixing the pro-drugs (single proteins in the case of formats 1, 2 and 4 and two proteins in the case of format 3) having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions.

The pro-drug compositions of the invention are administered to a subject, in accord with known methods, such as intravenous administration as a bolus or by continuous infusion over a period of time.

The pro-drug compositions of the invention are useful in the treatment of cancer.

EXAMPLES

A. Example 1: Pro Construct Construction and Purification

Transfections

Each protein (e.g. single proteins for Formats 1, 2 and 4) or pairs of constructs (Format 3) were expressed from a separate expression vector (pcdna3.4 derivative). Equal amounts of plasmid DNA that encoded the pair of hemi-cobra or single chain constructs were mixed and transfected to Expi293 cells following the manufacture's transfection protocol. Conditioned media was harvested 5 days post transfection by centrifugation (6000 rpm×25') and filtration (0.2 uM filter). Protein expression was confirmed by SDS-PAGE. Constructs were purified and the final buffer composition was: 25 mM Citrate, 75 mM Arginine, 75 mM NaCl, 4% Sucrose, pH 7. The final preparations were stored at −80° C.

Activation of MMP9

Recombinant human (rh) MMP9 was activated according to the following protocol. Recombinant human MMP-9 (R&D #911-MP-010) is at 0.44 mg/ml (4.7 uM). p-aminophenylmercuric acetate (AMA) (Sigma) is prepared at the stock concentration of 100 mM in DMSO. Assay buffer is 50 mM Tris pH 7.5, 10 mM CaCl2, 150 mM NaCl, 0.05% Brij-35.

Dilute rhMMP9 with assay buffer to ~100 ug/ml (25 ul hMMP9+75 uL assay buffer)

Add p-aminophenylmercuric acetate (APMA) from 100 mM stock in DMSO to a final concentration of 1 mM (1 uL to 100 uL)

Incubate at 37'C for 24 hrs

Dilute MMP9 to 10 ng/ul (add 900 ul of assay buffer to 100 ul of activated solution)

The concentration of the activated rhMMP9 is ~100 nM.

Cleavage of Constructs for TDCC Assays

To cleave the constructs, 100 ul of the protein sample at 1 mg/ml concentration (10.5 uM) in the formulation buffer (25 mM Citric acid, 75 mM L-arginine, 75 mM NaCl, 4% sucrose) was supplied with $CaCl_2$ up to 10 mM. Activated rhMMP9 was added to the concentration 20-35 nM. The sample was incubated at room temperature overnight (16-20 hrs). The completeness of cleavage was verified using SDS PAGE (10-20% TG, TG running buffer, 200v, 1 hr). Samples were typically 98% cleaved.

B. Example 2: T Cell Dependent Cellular Cytotoxicity (TDCC) Assays

Firefly Luciferase transduced HT-29 cells were grown to approximately 80% confluency and detached with Versene (0.48 mM EDTA in PBS-Ca-Mg). Cells were centrifuged and resuspended in TDCC media (5% Heat Inactivated FBS in RPMI 1640 with HEPES, GlutaMax, Sodium Pyruvate, Non-essential amino acids, and β-mercaptoethanol). Purified human Pan-T cells were thawed, centrifuged and resuspended in TDCC media.

A coculture of HT-29_Luc cells and T cells was added to 384-well cell culture plates. Serially diluted COBRAs were then added to the coculture and incubated at 37° C. for 48 hours. Finally, an equal volume of SteadyGlo luciferase assay reagent was added to the plates and incubated for 20 minutes. The plates were read on the Perkin Elmer Envision with an exposure time of 0.1s/well. Total luminescence was recorded and data were analyzed on GraphPad Prism 7 or Version 8.3.1 (depending on timing).

C. Example 3: General Protocol Design of the In Vivo Adoptive T Cell Transfer Efficacy Model These protocols were used in many of the experiments of the figures. Tumor cells were implanted subcutaneous (SC) in the right flank of NSG (NOD.Cg-Prkdcscid Il2rgtm1Wjl/SzJ) mice (The Jackson Laboratory, Cat. No. 005557) and allowed to grow until an established tumor with a mean volume of around 200 mm$^3$ was reached. In parallel human T cells were cultured in T cell media (X-VIVO 15 [Lonza, Cat. No. 04-418Q], 5% Human Serum, 1% Penicillin/Streptomycin, 0.01 mM 2-Mercaptoethanol) in a G-Rex100M gas permeable flask (Wilson Wolf Cat. No. 81100S) with MACSiBeads from the T Cell Activation/Expansion Kit (Miltenyi Cat. No. 130-091-441) for around 10 days and supplemented with recombinant human IL-2 protein. Tumor growth in mice and human T cell activation/expansion were coordinated so that on Day 0 of the study mice were randomized into groups (N=6) based on tumor size; each were then injected intravenous (IV) with 2.5×10$^6$ cultured human T cells and administered the first dose of the COBRA or control molecules. Mice were dosed every 3 days for 7 doses (Days 0, 3, 6, 9, 12, 15 and 18) and then followed for an additional 2-3 weeks until tumors reached >2000 mm$^3$ in volume or the study was terminated. Tumor volumes were measured every 3 days.

D. Example 4: In Vivo Activity with EGFR/MMP9 Hemi-COBRA Pair Pro77 and Pro53

5×10$^6$ LoVo cells or 5×10$^6$ HT29 cells were implanted subcutaneous in the right flank of NSG (NOD.Cg-Prkdcscid Il2rgtm1Wjl/SzJ) mice (The Jackson Laboratory, Cat. No. 005557) and allowed to grow until tumors were established. In parallel human T cells are cultured in T cell media (X-VIVO 15 [Lonza, Cat. No. 04-418Q], 5% Human Serum, 1% Penicillin/Streptomycin, 0.01 mM 2-Mercaptoethanol) in a G-Rex100M gas permeable flask (Wilson Wolf Cat. No. 81100S) with MACSiBeads from the T Cell Activation/Expansion Kit (Miltenyi Cat. No. 130-091-441) for 10 days and supplemented with recombinant human IL-2 protein. Tumor growth in mice and human T cell activation/expansion were coordinated so that on Day 0 of the study mice were randomized into groups (N=6) based on tumor size; each were then injected intravenous (IV) with 2.5×10$^6$ cultured human T cells and administered the first dose of the COBRA or control molecules. Mice were dosed every 3 days for 7 doses (Days 0, 3, 6, 9, 12, 15 and 18) and then followed until tumors reach >2000 mm$^3$ in volume or the study was terminated. Groups received 0.2 mg/kg (mpk) of the anti-EGFR×CD3 positive control Pro51 bispecific antibody (bsAb), 0.5 mpk of the negative control anti-hen egg lysozyme (HEL)×CD3 bsAb Pro98, 0.5 mpk each of the MMP9 cleavable linker containing anti-EGFR hemi-COBRA pair Pro77 and Pro53, or 0.5 mpk each of the non-cleavable(NCL) linker containing anti-EGFR hemi-COBRA pair Pro74 and Pro72. Tumor volumes were measured every 3 days.

E. Example 5: In Vivo Activity with EGFR/MMP9 COBRA Pro140

5×10$^6$ LoVo cells or 5×10$^6$ HT29 cells were implanted subcutaneous in the right flank of NSG (NOD.Cg-Prkdcscid Il2rgtm1Wjl/SzJ) mice (The Jackson Laboratory, Cat. No. 005557) and allowed to grow until tumors were established. In parallel human T cells are cultured in T cell media (X-VIVO 15 [Lonza, Cat. No. 04-418Q], 5% Human Serum, 1% Penicillin/Streptomycin, 0.01 mM 2-Mercaptoethanol) in a G-Rex100M gas permeable flask (Wilson Wolf Cat. No. 81100S) with MACSiBeads from the T Cell Activation/Expansion Kit (Miltenyi Cat. No. 130-091-441) for 10 days and supplemented with recombinant human IL-2 protein. Tumor growth in mice and human T cell activation/expansion were coordinated so that on Day 0 of the study mice were randomized into groups (N=6) based on tumor size; each were then injected intravenous (IV) with 2.5×10$^6$ cultured human T cells and administered the first dose of the COBRA or control molecules. Mice were dosed every 3 days for 7 doses (Days 0, 3, 6, 9, 12, 15 and 18) and then followed until tumors reach >2000 mm$^3$ in volume or the study was terminated. Groups received 0.2 mpk of the anti-EGFR×CD3 positive control Pro51 bispecific antibody (bsAb), 0.5 mpk of the negative control anti-hen egg lysozyme (HEL)×CD3 bsAb Pro98, or 0.5 mpk of the MMP9 cleavable linker containing anti-EGFR COBRA Pro140. Tumor volumes were measured every 3 days.

F. Example 6: In Vivo Activity with EGFR/MMP9 COBRA Pro186

5×10$^6$ HT29 cells were implanted subcutaneous in the right flank of NSG (NOD.Cg-Prkdcscid Il2rgtm1Wjl/SzJ) mice (The Jackson Laboratory, Cat. No. 005557) and allowed to grow until tumors were established. In parallel human T cells are cultured in T cell media (X-VIVO 15 [Lonza, Cat. No. 04-418Q], 5% Human Serum, 1% Penicillin/Streptomycin, 0.01 mM 2-Mercaptoethanol) in a G-Rex100M gas permeable flask (Wilson Wolf Cat. No. 81100S) with MACSiBeads from the T Cell Activation/Expansion Kit (Miltenyi Cat. No. 130-091-441) for 10 days and supplemented with recombinant human IL-2 protein. Tumor growth in mice and human T cell activation/expansion were coordinated so that on Day 0 of the study mice were randomized into groups (N=6) based on tumor size; each were then injected intravenous (IV) with 2.5×10$^6$ cultured human T cells and administered the first dose of the COBRA or control molecules. Mice were dosed every 3 days for 7 doses (Days 0, 3, 6, 9, 12, 15 and 18) and then followed until tumors reach >2000 mm$^3$ in volume or the study was terminated. Groups received 0.1 mg/kg (mpk) of the anti-EGFR×CD3 positive control Pro51 bispecific antibody (bsAb), 0.3 mpk of the of the non-cleavable (NCL) control linker containing anti-EGFR COBRA Pro214, 0.1 or 0.3 mpk of the MMP9 cleavable linker containing anti-EGFR COBRA Pro140, or 0.1 or 0.3 mpk of the MMP9 cleavable linker containing anti-EGFR COBRA Pro186. Tumor volumes were measured every 3 days.

G. Example 7: Successful Humanization of Anti-EGFR Sequences

The results are shown below.

| Molecule | KD (M) | Kon (1/Ms) | Kdis(1/s) |
|---|---|---|---|
| Pro22 (parental EGFR) | 2.58E−09M/2.6 nM | 2.05E+05 | 5.27E−04 |
| Pro90 (hEGFRl) | 2.00E−09M/2.0 nM | 2.21E+05 | 4.40E−04 |
| Pro48 (EGFR2) | 2.89E−09M/2.9 nM | 6.09E+05 | 1.76E−03 |

| Molecule | KD (M) | Kon (1/Ms) | Kdis(1/s) |
|---|---|---|---|
| Pro137 (hEGFR2) | 4.36E−09M/4.4. nM | 5.85E+05 | 2.55E−03 |
| Pro51 (hEGFR2) | 3.27E−09M/3.2 nM | 6.45E+05 | 2.11E−03 |
| Pro201 (hEGFR2 with 2 binding sites) | 2.25E−12M/2.3 pM | 1.55E+06 | 3.48E−06 |

These results show both that the humanization of the EGFR binding domains was successful, and that there is strong avidity to the target EGFR when two binding sites are on the molecule.

Example: Successful Humanization of EpCAM sdABDs

The results are shown below.

| Clone | Human binding affinity (nM) | Cyno binding affinity (nM) | Cyno/Human cross reactivity |
|---|---|---|---|
| VIB-13 | 2.3 | 11.6 | 5 |
| hVIB-13 | 2.8 | 12.7 | 4.5 |
| VIB-23 | 4.2 | 46.7 | 11.1 |
| hVIB-23 | 4.1 | 58.8 | 12.6 |

These results show both that the humanization of the EpCAM binding domains was successful.

H. Example 8: COBRA™: A Novel Conditionally Active Bispecific Antibody that Regresses Established Solid Tumors in Mice Despite clinical success with bispecific antibodies (bsAbs) targeting hematological malignancies (e.g. blinatumomab, a CD19×CD3 bsAb), efficacy in solid tumor indications remains a significant challenge. Because T cell redirecting bsAbs are so potent, even very low levels of cell surface target antigen expression on normal tissues may quickly become a safety liability and severely restrict the dose levels that can be achieved in patients. This limits the likelihood of reaching efficacious concentrations and reduces the therapeutic potential of these highly active molecules. Additionally, identifying "clean" target antigens that are uniquely expressed on the tumor and not on normal tissues has been very difficult at best.

To overcome these challenges, we have developed a novel recombinant bsAb platform called COBRA™ (Conditional Bispecific Redirected Activation). COBRAs are engineered to enable targeting of more widely expressed and validated tumor cell surface antigens by focusing T cell engagement within the tumor microenvironment. COBRA molecules are designed to bind to target antigen, which may be expressed on both tumor and normal cells, yet not engage T cells unless exposed to a proteolytic microenvironment, which is common in tumors but not in normal healthy tissues. Once bound to the tumor target antigen, protease-dependent linker cleavage allows COBRAs to convert an inactive anti-CD3 scFv to an active anti-CD3 scFv binding domain. Upon conversion, COBRAs are then able to simultaneously co-engage T cells and target antigen, resulting in a potent cytolytic T cell response against the tumor cells. In addition, COBRAs are designed with a half-life extension moiety that is removed from the active molecule upon proteolytic cleavage. This allows for a sustained presence in the circulation of the inactive COBRA prior to tumor target binding, and more rapid clearance of unbound active COBRA molecules, thereby decreasing the potential for cytotoxic activity in normal tissues.

Here we have revealed the novel design of the COBRA molecule and demonstrate its ability to engage CD3 and Epidermal Growth Factor Receptor (EGFR) to elicit potent cytotoxic activity in T cell culture and in human T cell implanted tumor-bearing mice. We have reported low-to-sub-picomolar T cell activation and cytotoxicity in vitro, and COBRA linker cleavage dependent T cell mediated regression of established solid tumor xenografts in NSG mice in vivo.

Figure 64A:
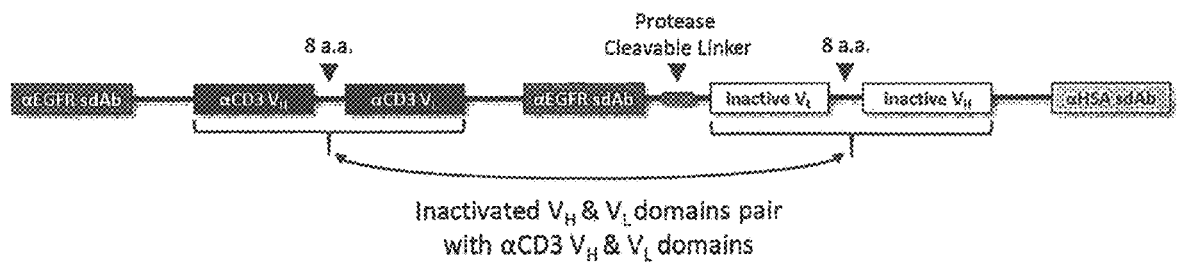
FIG. 64A-64C illustrate the COBRA design and the predicted folding mechanism.
Figure 64B:
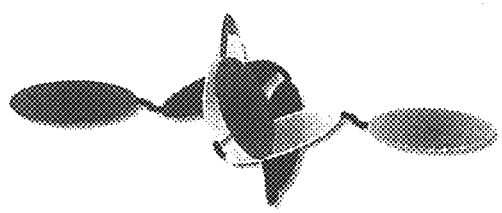
Figure 64C:
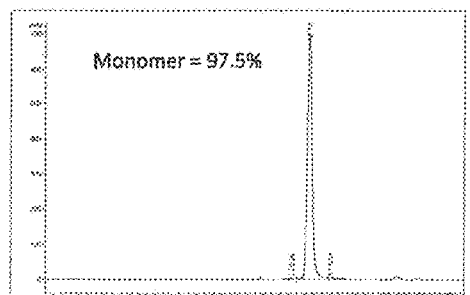

FIG. 64A-64C illustrate the COBRA design and the predicted folding mechanism. FIG. 64A depicts a schematic of the PRO186 COBRA. FIG. 64B shows the predicted COBRA folding. The COBRA includes inactive VH and VL paired with anti-CD3 VH and VL domains. The uncleaved PRO186 COBRA binds EGFR, has impaired CD3 binding, and binds serum albumin. FIG. 64C shows an analytical size exclusion chromatogram of PRO186. The data shows that the uncleaved PRO186 folds into a single structure.

Figure 65A:
FIG. 65A-FIG. 65C depict exemplary embodiments of the constructs described herein including Pro186 (pre-cleaved), Pro186 cleavage products, and PRO186 active dimer.
Figure 65B:
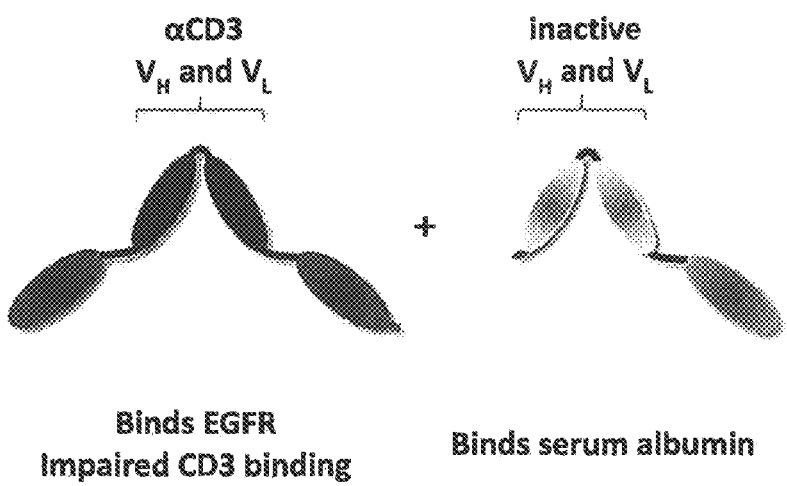
Figure 65C:
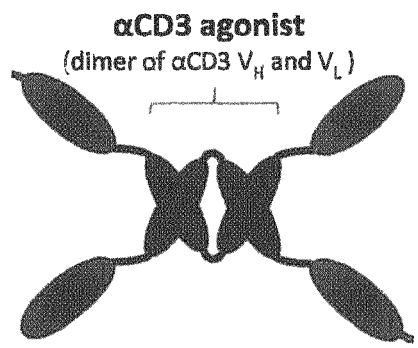

FIG. 65A-FIG. 65C depict exemplary embodiments of the constructs described herein including PRO186 (Pro186 pre-cleaved), PRO186 cleavage products, and PRO186 active dimer. One cleavage product includes anti-CD3 VH and VL domains and it binds EGFR and has impaired CD3 binding. The other cleavage product includes anti-CD3 inactive VH and VL domains and binds serum albumin. An active PRO186 dimer includes an active anti-CD3 agonist (a dimer of anti-CD3 VH and VL) and binds CD3 and EGFR.

Figure 66:
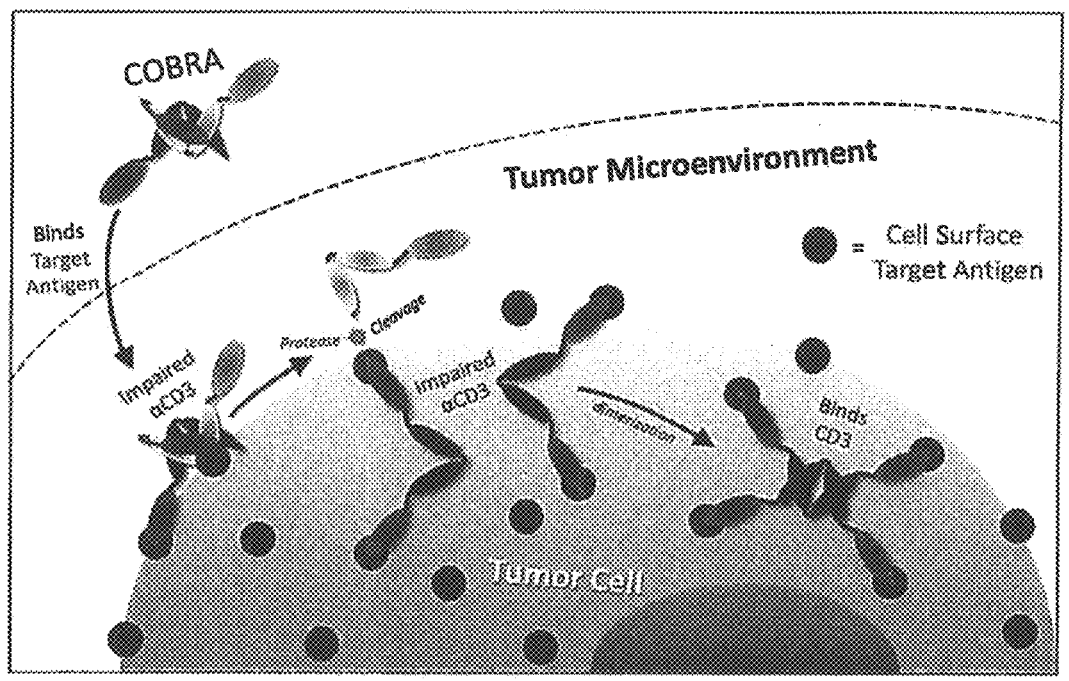
FIG. 66 provides an illustration of COBRA conversion to an active dimer upon protease cleavage.

FIG. 66 provides an illustration of COBRA conversion to an active dimer upon protease cleavage.

Figures 67A, 67B:
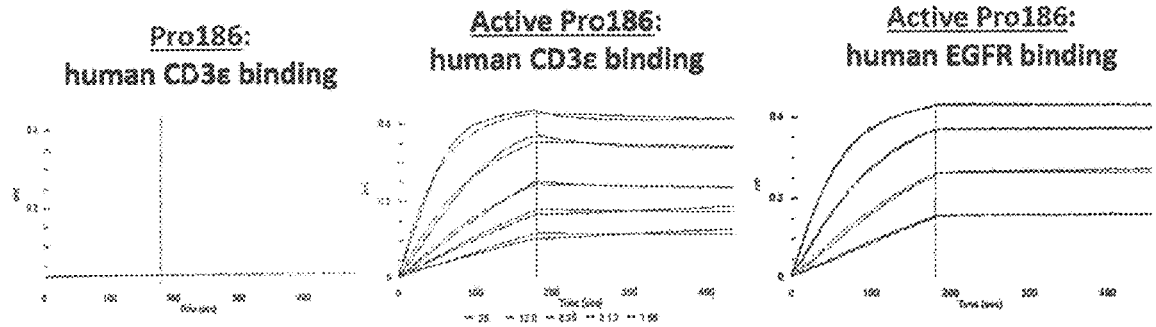
FIG. 67A-FIG. 67B provide characterization of COBRA binding.

FIG. 67A-FIG. 67B provide characterization of COBRA binding. FIG. 67A shows binding activity to human, cyno, and mouse articles. FIG. 67B shows PRO186 binding to human CD3epsilon; active PRO186 binding of human CD3epsilon, and active PRO186 binding of human EGFR. Binding kinetics were assessed by Octet (Forte Bi) with EGFR (Acro Biosystems), serum albumin (Athens Research Technology), and CD3€ (Creative Biomart).

Figure 68A:
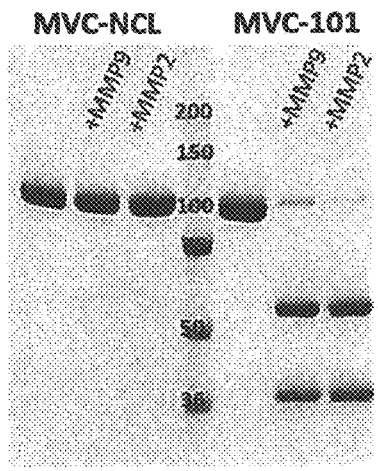
FIG. 68A-FIG. 68B show cleavage of the PRO186 linker by MMP2 and MMP9.
Figure 68B:
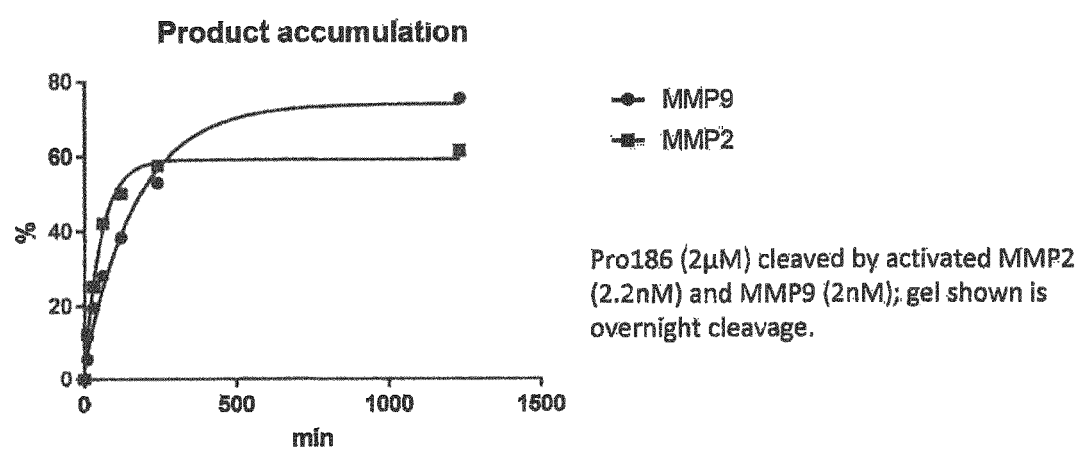

FIG. 68A-FIG. 68B shows cleavage of the PRO186 linker by MMP2 and MMP9. FIG. 68A depicts a western blot of the active binding product molecules upon cleavage. FIG. 68B shows accumulation of the active binding product molecules relative to the cleavage time.

FIG. 69 shows in vitro activity of the conditional PRO186 construct. FIG. 69—left panel shows results of a T cell killing assay. FIG. 69—right panel shows the level of IFN-gamma release in relations to the concentration of the test articles.

FIG. 70 shows EGFR expression relative to activity in three tumor cell lines—LoVo (a colorectal cancer (CRC) cell line), HT-29 (a colorectal cancer (CRC) cell line), and SCC25 (a head and neck cancer cell line). For in vitro EGFR expression, antibodies bound/cell was measured using 1:1 PE labeled anti-EGFR mAb #EGFR.1 and BD QuantiBrite Beads. For in vivo EGFR expression, IHC staining was performed using anti-EGFR mAb #WP84 and MACH4-HRP detection (Ensigna). For the T cell killing assay luciferase expressing tumor cells were co-cultured with human T cells at an E:T of 10:1 for 48 hours and measured by Steady-Glo (Promega). For the IFNγ release assay, IFNγ was measured using Meso Scale Discovery V-Pex at E:T 10:1 at 24 hours.

Figure 71A:
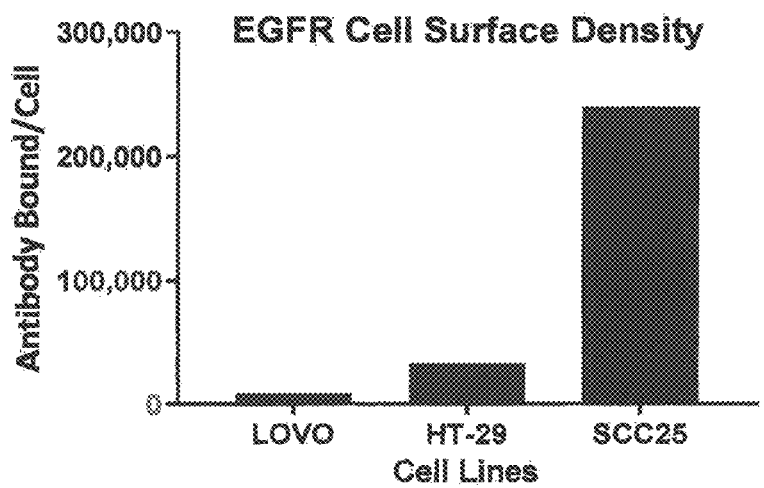
FIG. 71A and FIG. 71B show EGFR, MMP2, and MMP9 expression on tumor cells and tumor xenografts.
Figure 71B:
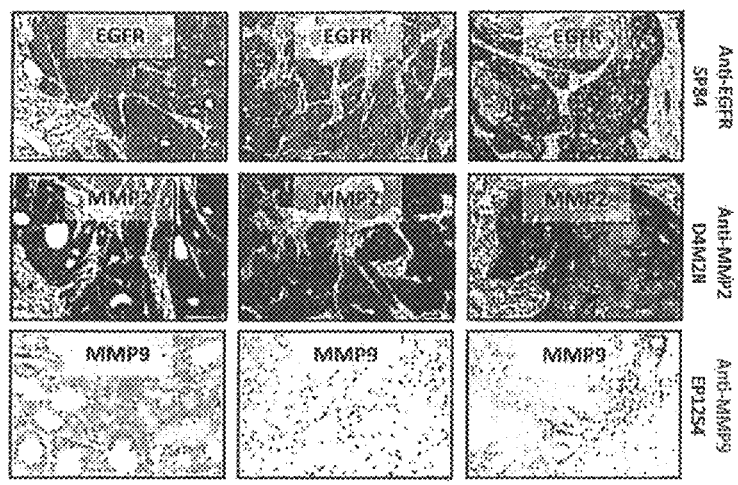

FIG. 71A and FIG. 71B show EGFR, MMP2, and MMP9 expression on tumor cells and tumor xenografts. FIG. 71A shows EGFR cell surface density on the three cancer cell lines—LoVo, HT-29, and SCC25. FIG. 71B shows immunohistochemistry staining of EGFR, MMP2, and MMP9 of tumor xenografts.

Figure 72:
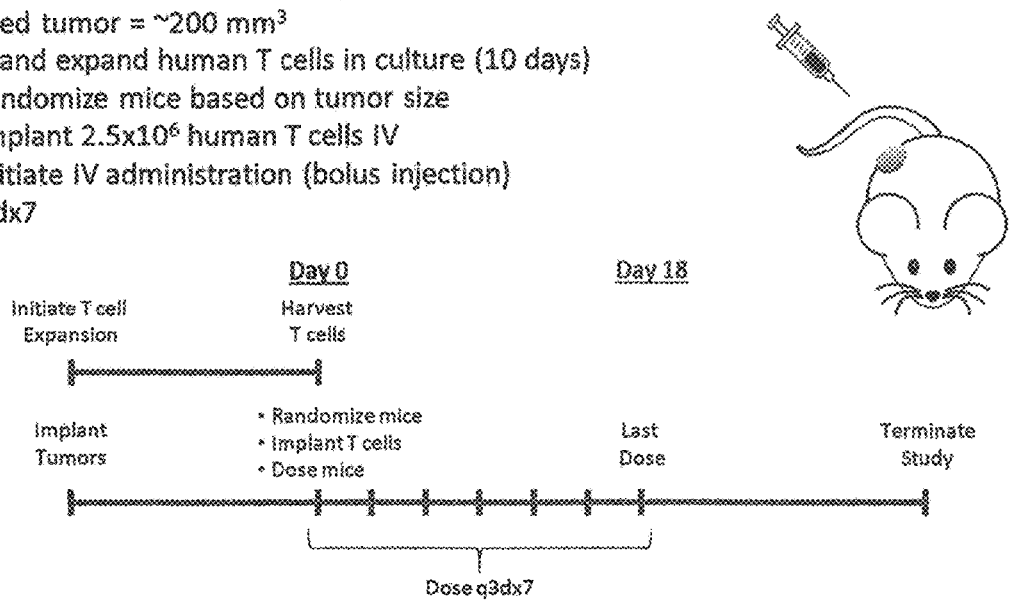
FIG. 72 provides a schematic diagram of the experimental procedure of the adoptive human T cell transfer model in tumor bearing mice.

FIG. 72 provides a schematic diagram of the experimental procedure of the adoptive human T cell transfer model in tumor bearing mice. The experiments were used to measure in vivo anti-tumor efficacy and pharmacokinetics (PK). The procedure included (1) implanting tumors subcutaneously in the right flank of NSG mice, (2) allowing the development of an established tumor such as a tumor that is about 200 mm3, (3) dosing mice q3dx7 beginning on Day 0, (4) administering the last dose on Day 18, and (5) terminating the study. The procedure also included the following, which were performed in parallel with the in vivo experimentation: (a) activating and expanding human T cells in culture for 10 days such that the expansion was initiated on the same time course as the implantation of tumors, and (b) harvesting the T cells on Day 0.

Figure 73:
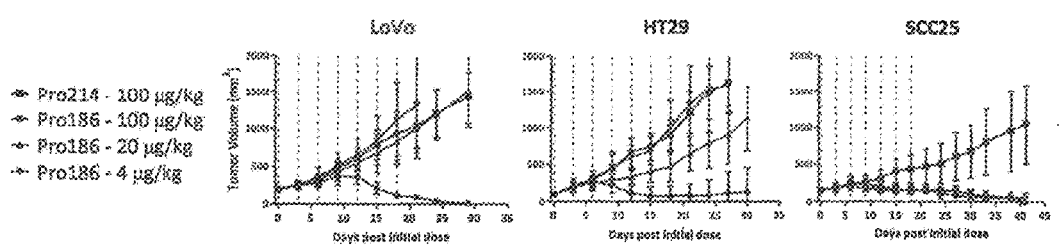
FIG. 73 shows regression of the established solid tumors in mice by PRO186.

FIG. 73 shows regression of the established solid tumors in mice by PRO186. FIG. 73—left panel shows regression of LoVo-derived tumors. FIG. 73—middle panel shows regression of HT-29-derived tumors. FIG. 73—right panel shows regression of SCC25-derived tumors.

Figure 74A:
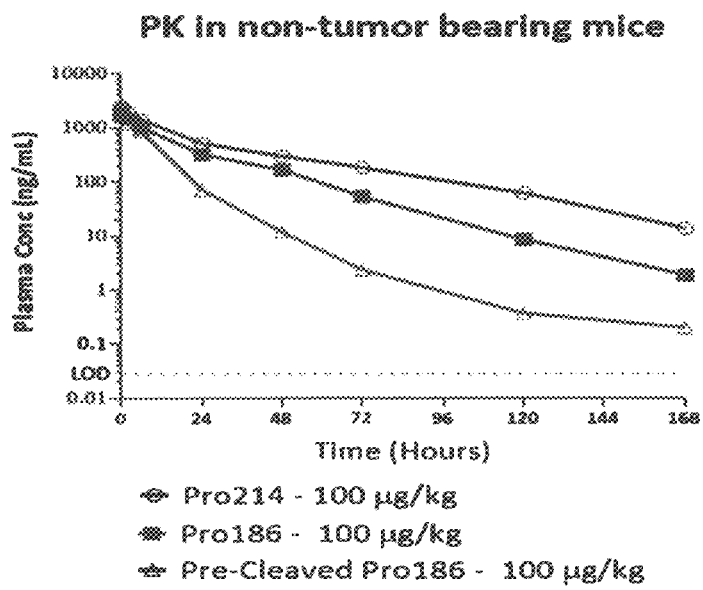
FIG. 74A-FIG. 74B shows that cleaved PRO186 clears more rapidly than intact (uncleaved) PRO186.
Figure 74B:
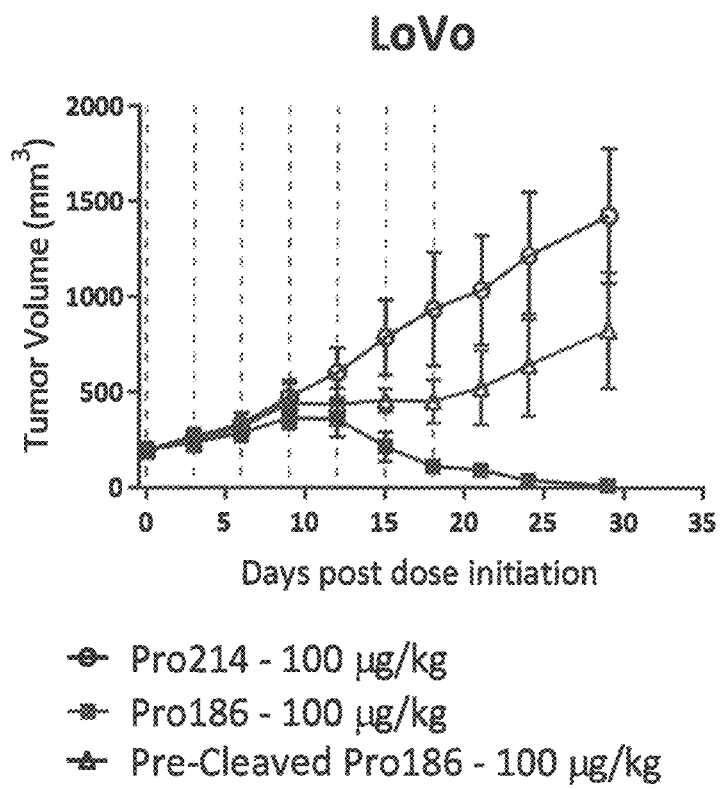
Figure 75:
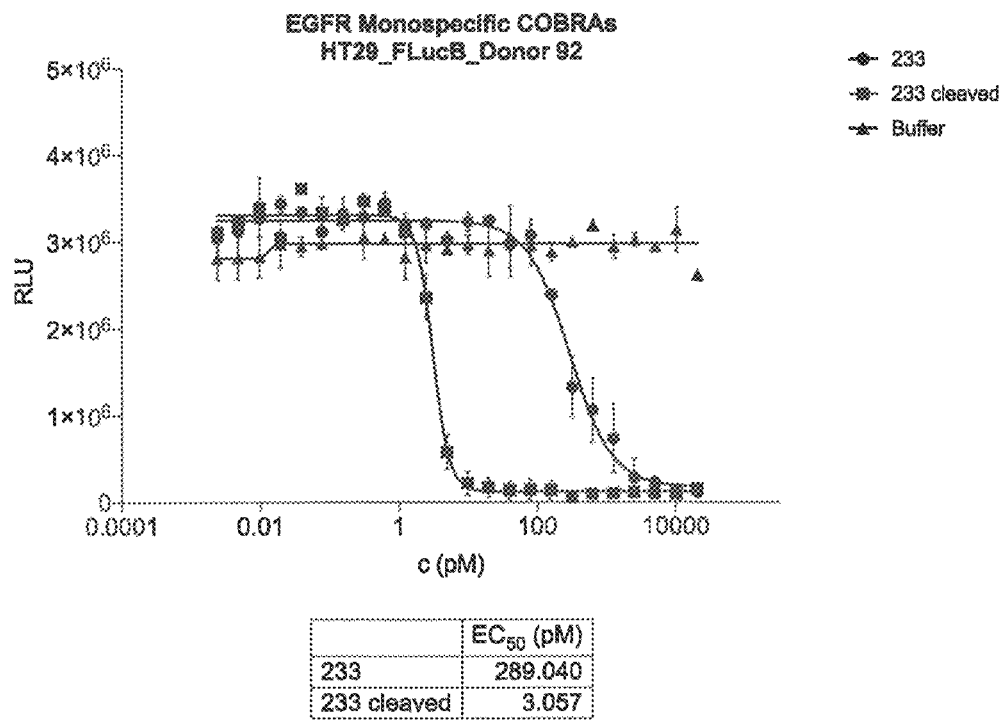
FIG. 75 depicts the results of a T cell dependent cellular toxicity (TDCC) assay using Pro233 and Pro233 cleaved with MMP9. Pro233 relies on the humanized anti-EGFR binding domain. The results show that cleaved Pro233 shows potency compared to the uncleaved form on EGFR-expressing HT29 cells.
Figure 76:
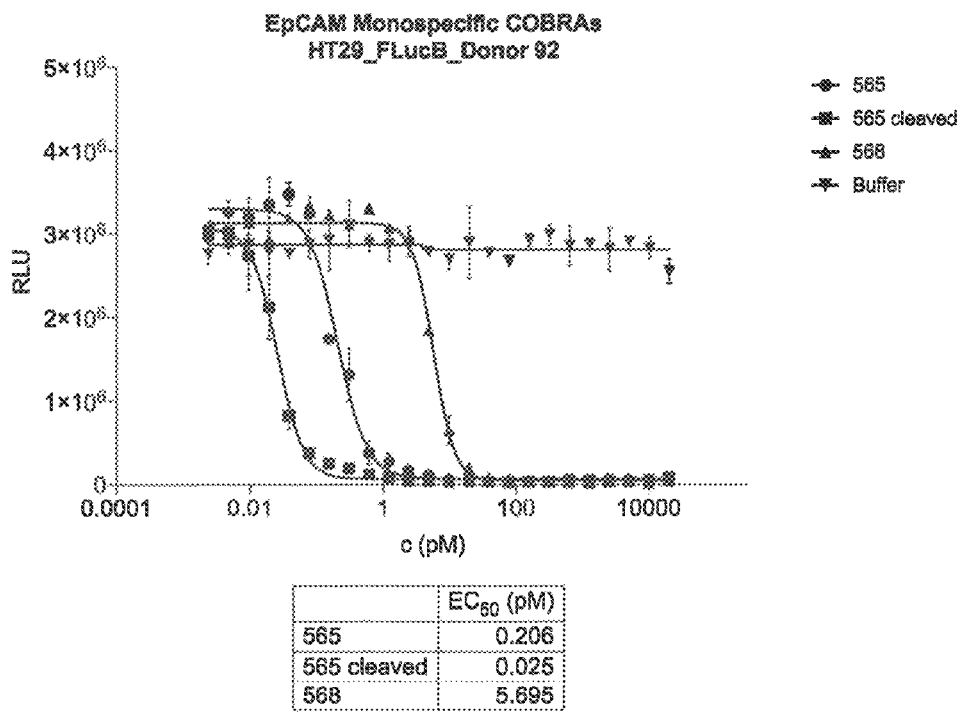
FIG. 76 depicts the results of a TDCC assay using Pro565, Pro565 cleaved by MMP9, and Pro568 (a noncleavable control). Pro565 relies on the hVIB664 anti-EpCAM binding domain. The results show that the cleaved Pro565 is more potent than the noncleaved version and the noncleavable control on EpCAM expressing HT29 tumor cells.
Figure 77:
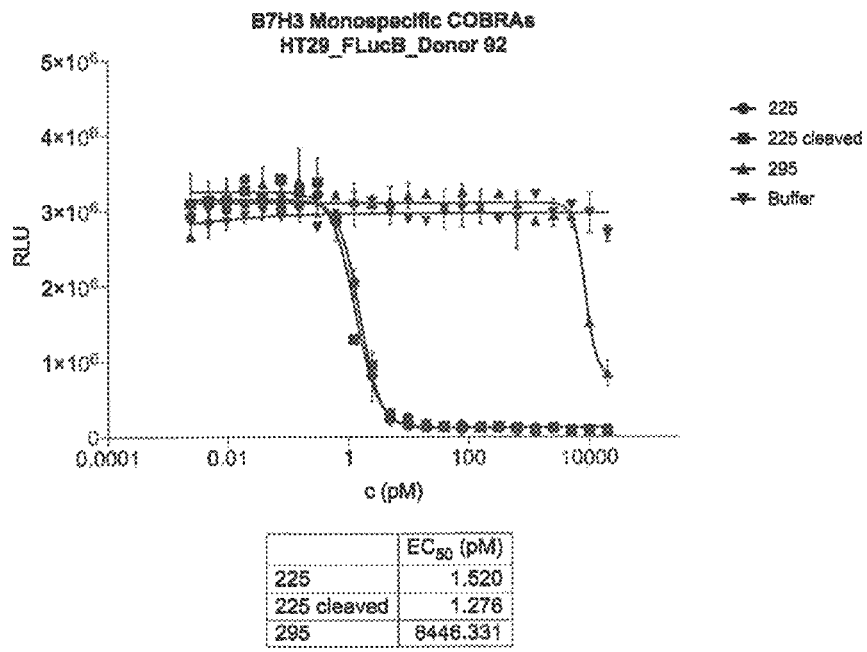
FIG. 77 depicts the results of a TDCC assay using Pro225, Pro225 cleaved by MMP9, and Pro295 (a noncleavable control). Pro225 relies on the hF7 anti-B7H3 binding domain. The results show that the cleaved Pro566 is more potent than the noncleaved version and the noncleavable control on B7H3 expressing HT29 tumor cells (note that HT29 express EGFR, B7H3 and EpCAM).
Figure 78:
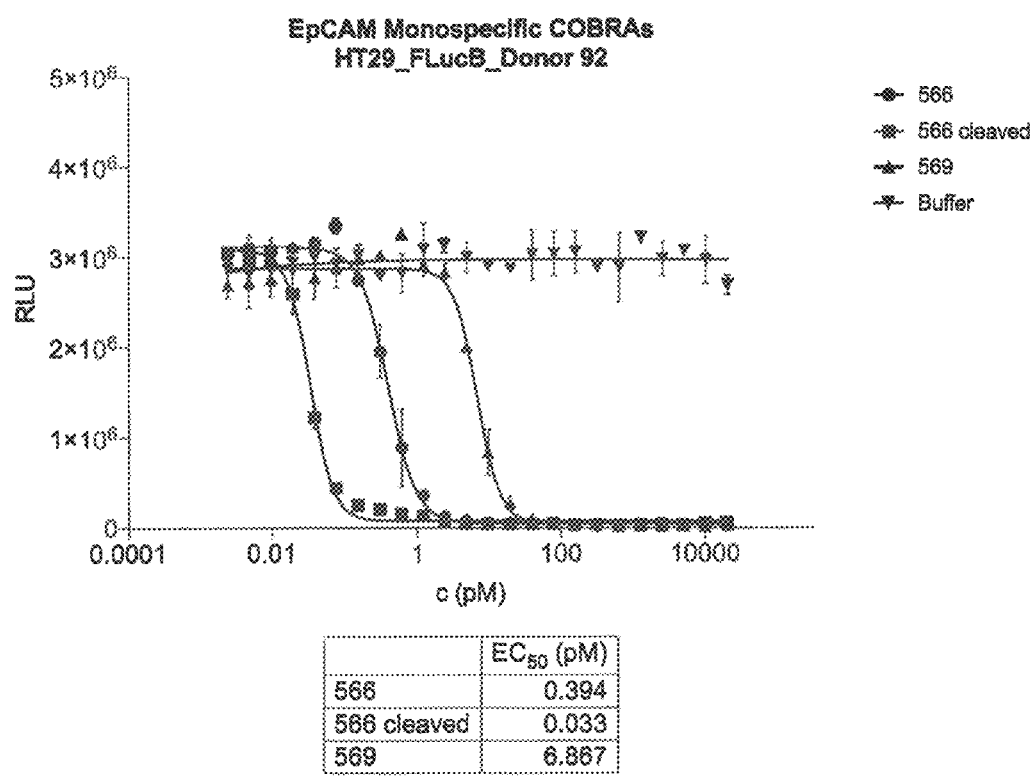
FIG. 78 depicts the results of a TDCC assay using Pro566, Pro566 cleaved by MMP9, and Pro569 (a noncleavable control). Pro566 relies on the hVIB665 anti-EpCAM binding domain. The results show that the cleaved Pro566 is more potent than the noncleaved version and the noncleavable control on EpCAM expressing HT29 tumor cells.
Figure 79:
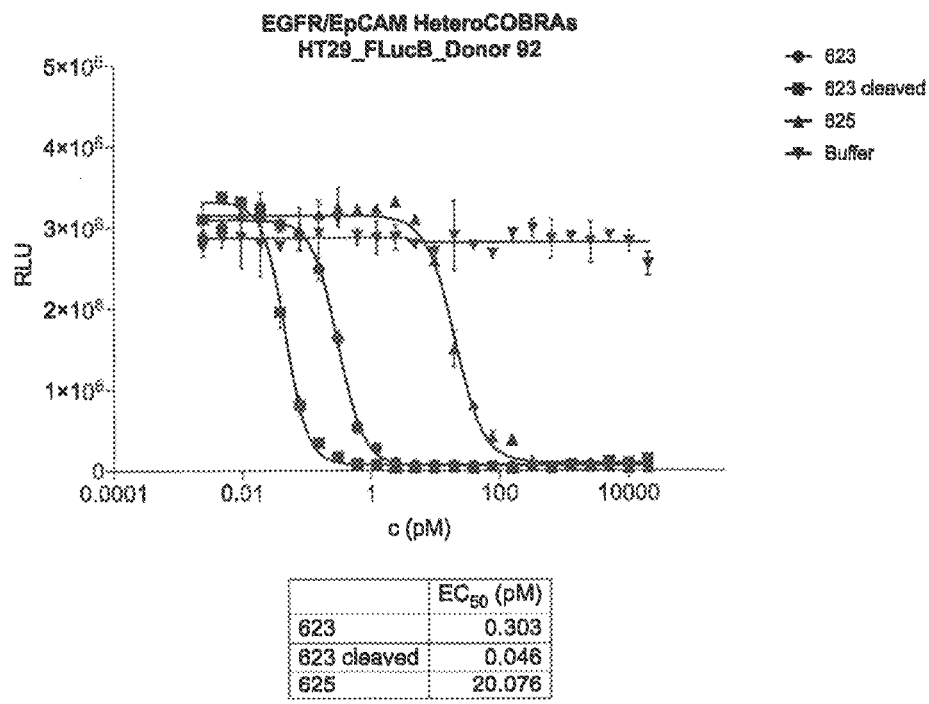
FIG. 79 depicts the results of a TDCC assay using dual targeting constructs (sometimes referred to herein as "hetero-COBRAs") to EGFR and EpCAM using the EGFR2 binding domain and the hVIB664 EpCAM binding domain. The results show that MMP9 cleaved Pro623 was more potent than either Pro623 uncleaved or Pro625, the non-cleavable control.
Figure 80:
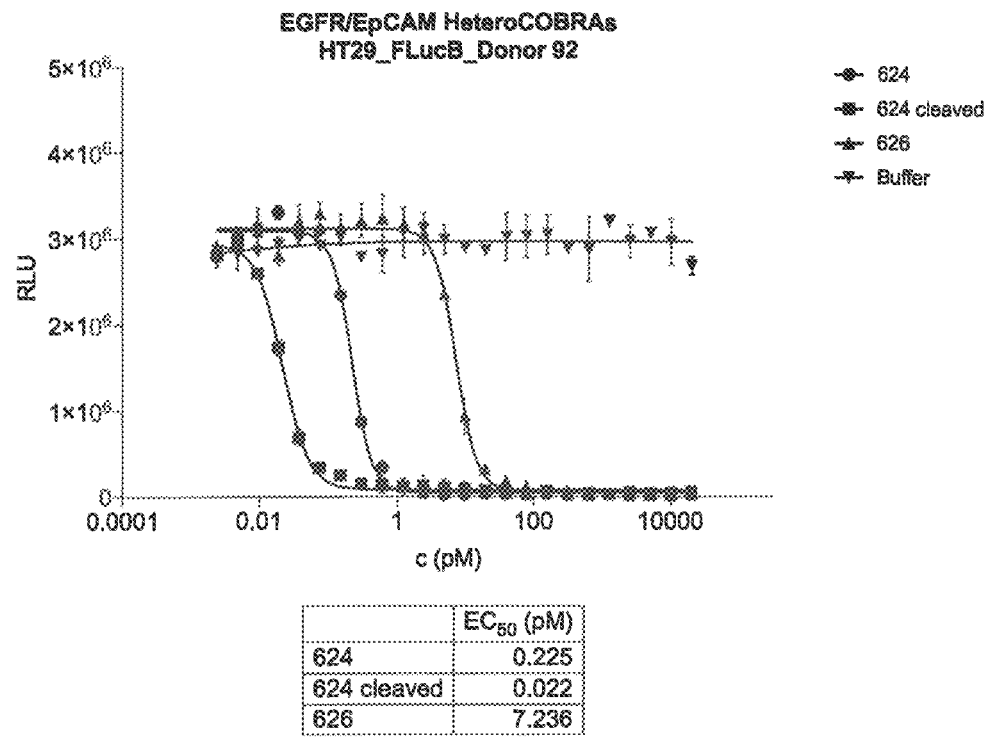
FIG. 80 depicts the results of a TDCC assay using dual targeting constructs to EGFR and EpCAM using the EGFR2 binding domain and the hVIB665 EpCAM binding domain. The results show that MMP9 cleaved Pro624 was more potent than either Pro624 uncleaved or Pro626, the non-cleavable control.
Figure 81:
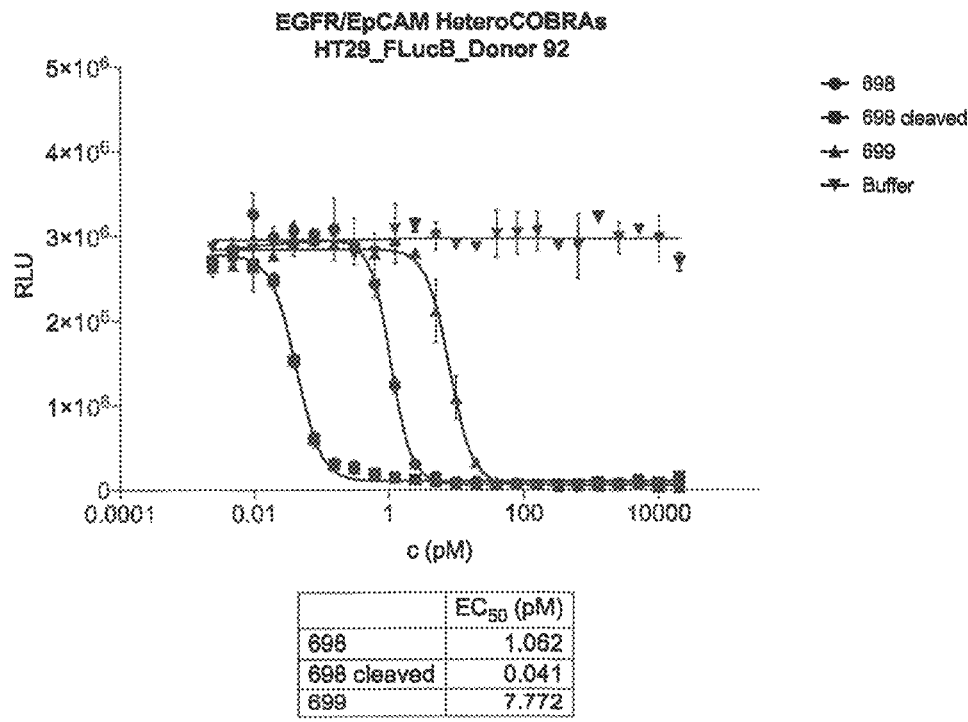
FIG. 81 depicts the results of a TDCC assay using dual targeting constructs to EGFR and EpCAM using the hEGFR2 binding domain and the hVIB665 EpCAM binding domain (in reverse orientation from Pro624). The results show that MMP9 cleaved Pro698 was more potent than either Pro698 uncleaved or Pro699, the non-cleavable control.
Figure 82:
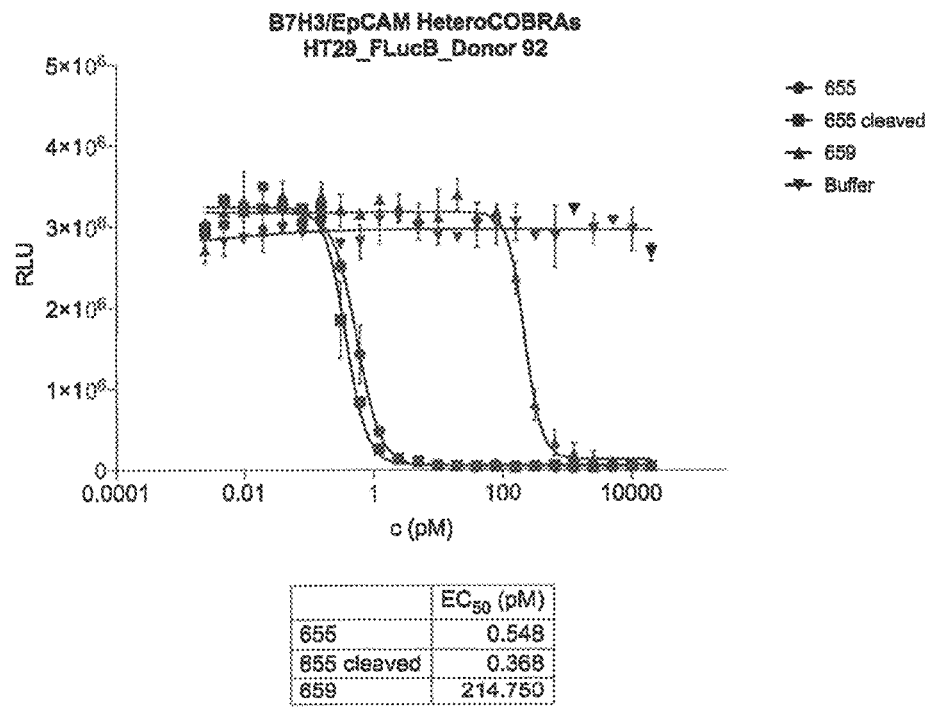
FIG. 82 depicts the results of a TDCC assay using dual targeting constructs to B7H3 and EpCAM using the hF7 B7H3 binding domain and the hVIB664 EpCAM binding domain in Pro655. The results show that MMP9 cleaved Pro665 was more potent than either Pro665 uncleaved or Pro659, the non-cleavable control.
Figure 83:
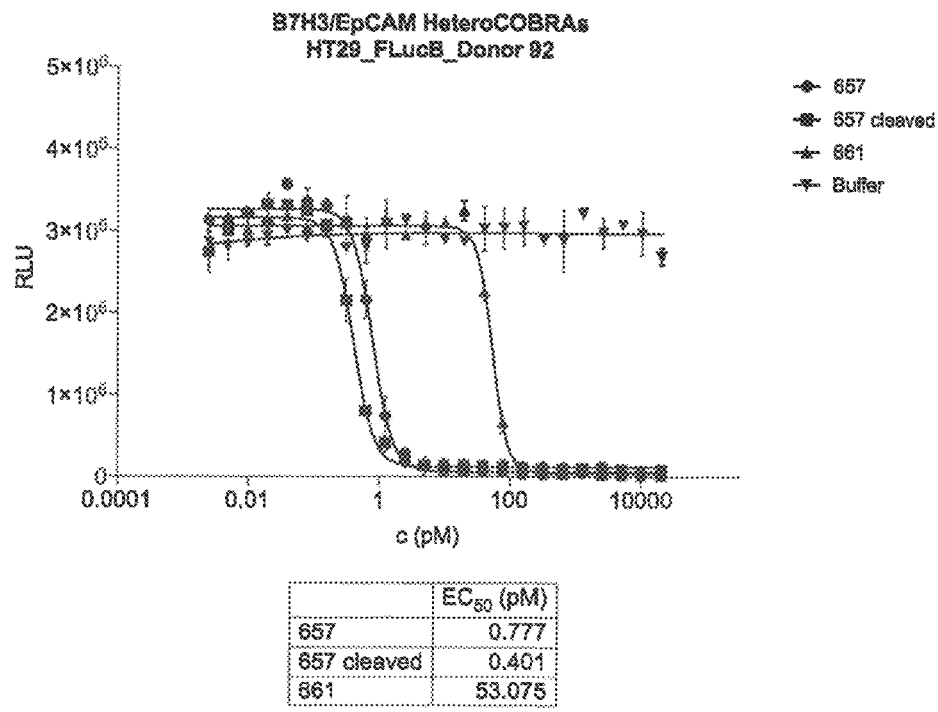
FIG. 83 depicts the results of a TDCC assay using dual targeting constructs to B7H3 and EpCAM using the hF7 B7H3 binding domain and the hVIB664 EpCAM binding domain in Pro657 (in reverse orientation from Pro655). The results show that MMP9 cleaved Pro657 was more potent than either Pro657 uncleaved or Pro661, the non-cleavable control.
Figure 84:
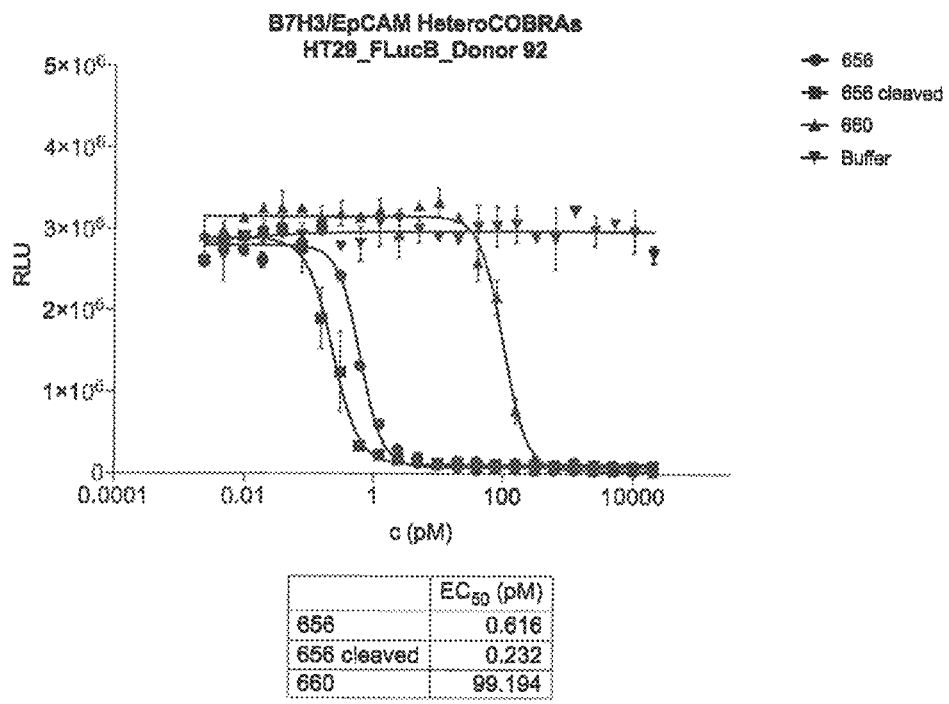
FIG. 84 depicts the results of a TDCC assay using dual targeting constructs to B7H3 and EpCAM using the hF7 B7H3 binding domain and the hVIB665 EpCAM binding domain in Pro656. The results show that MMP9 cleaved Pro656 was more potent than either Pro656 uncleaved or Pro660, the non-cleavable control.
Figure 85:
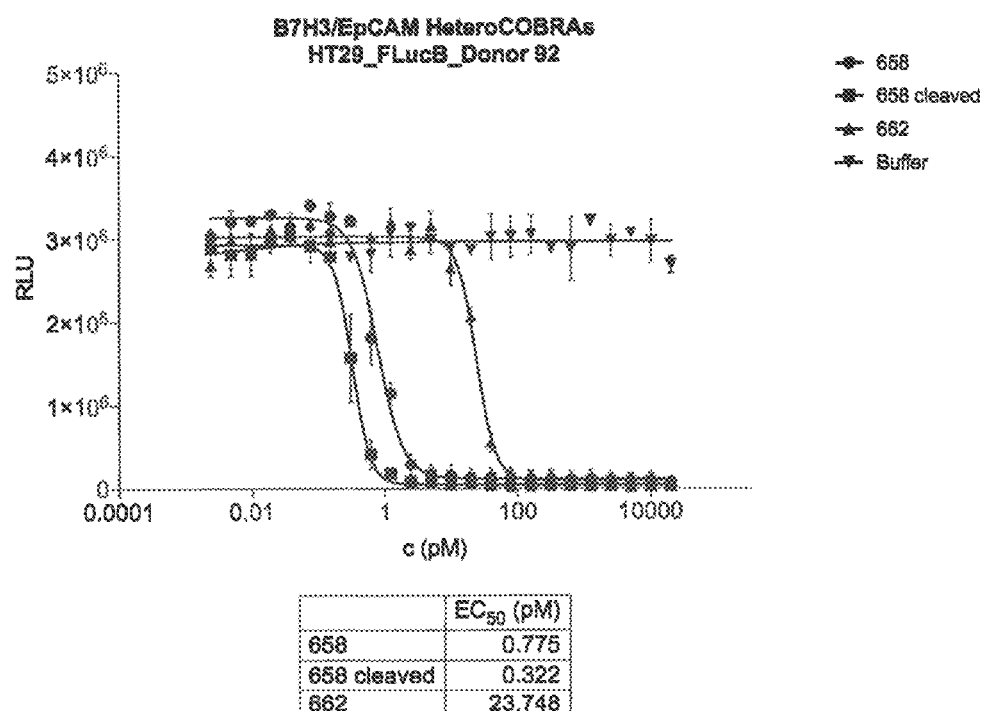
FIG. 85 depicts the results of a TDCC assay using dual targeting constructs to B7H3 and EpCAM using the hF7 B7H3 binding domain and the hVIB665 EpCAM binding domain in Pro658 (in the reverse orientation from Pro656). The results show that MMP9 cleaved Pro658 was more potent than either Pro658 uncleaved or Pro662 the non-cleavable control.
Figure 86:
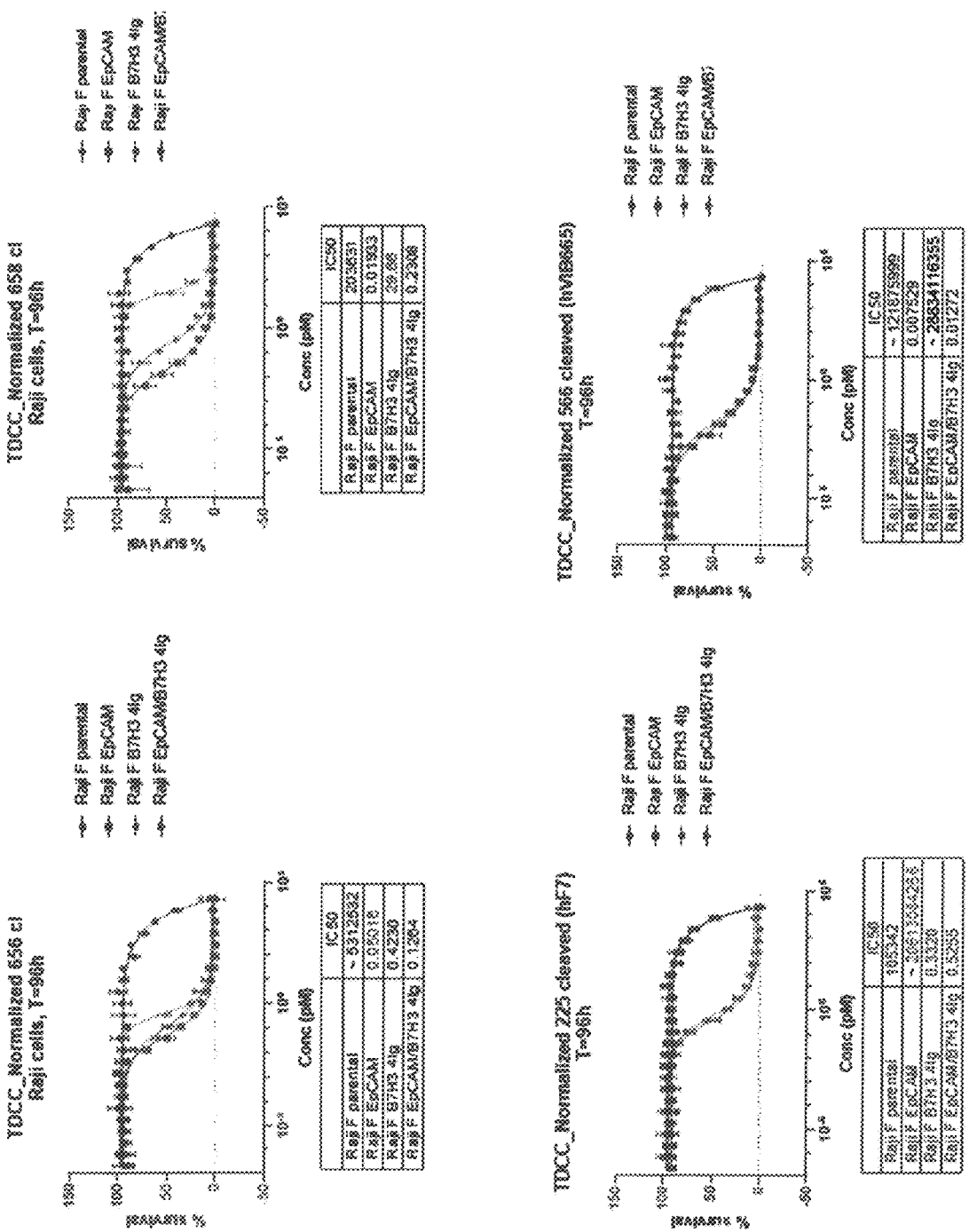
FIG. 86 depicts experiments that show that the dual targeting constructs Pro656 and Pro658 (differing in the orientation of the two domains) that bind to both B7H3 and EpCAM, kill all three cell types (those expressing B7H3 and not EpCAM, those expressing EpCAM and not B7H3 and those expressing both). In contrast, Pro225 (which has two anti-B7H3 domains) kills only two cell types (those expressing B7H3 and both B7H3 and EpCAM). Similarly, Pro566 (which has two anti-EpCAM domains) kills only two cell types, those expressing EpCAM and both B7H3 and EpCAM). Raji F cell lines transiently expressing the appropriate proteins were used.
Figure 87:
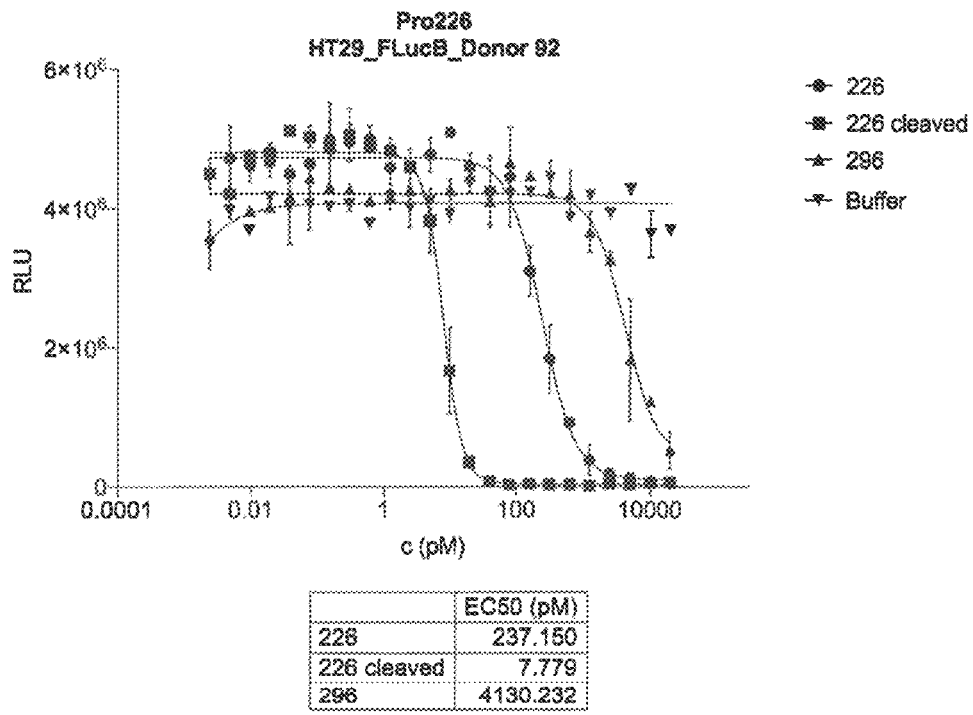
FIG. 87 depicts the results of a TDCC assay using a B7H3 targeting construct, Pro226. The results show that Pro226 and Pro226 cleaved with MMP9, show more activity than Pro296, the non-cleavable control. Pre-cleaved Pro226 shows an EC50 of about 8 pM.
Figure 88:
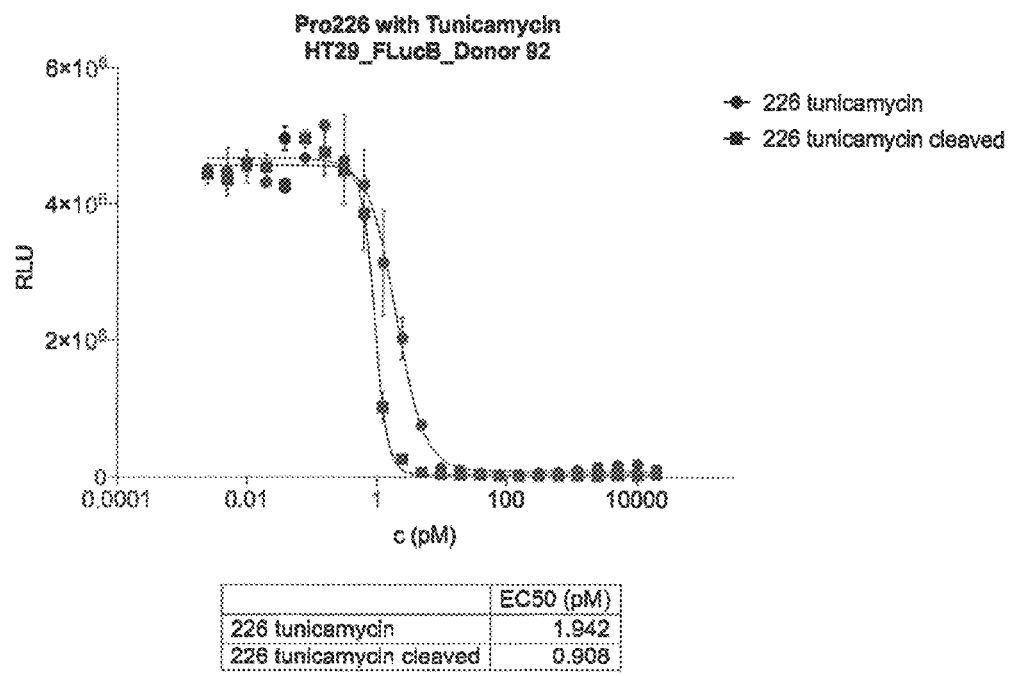
FIG. 88 depicts the results of a TDCC assay using Pro226 that was expressed in the presence of tunicamycin, which improves the potency of Pro226. Tunicamycin prevents glycosylation, and the EC50 of the cleaved product increases to 1 pM, showing that glycosylation is decreasing the EC50 (increasing the potency).
Figure 89:
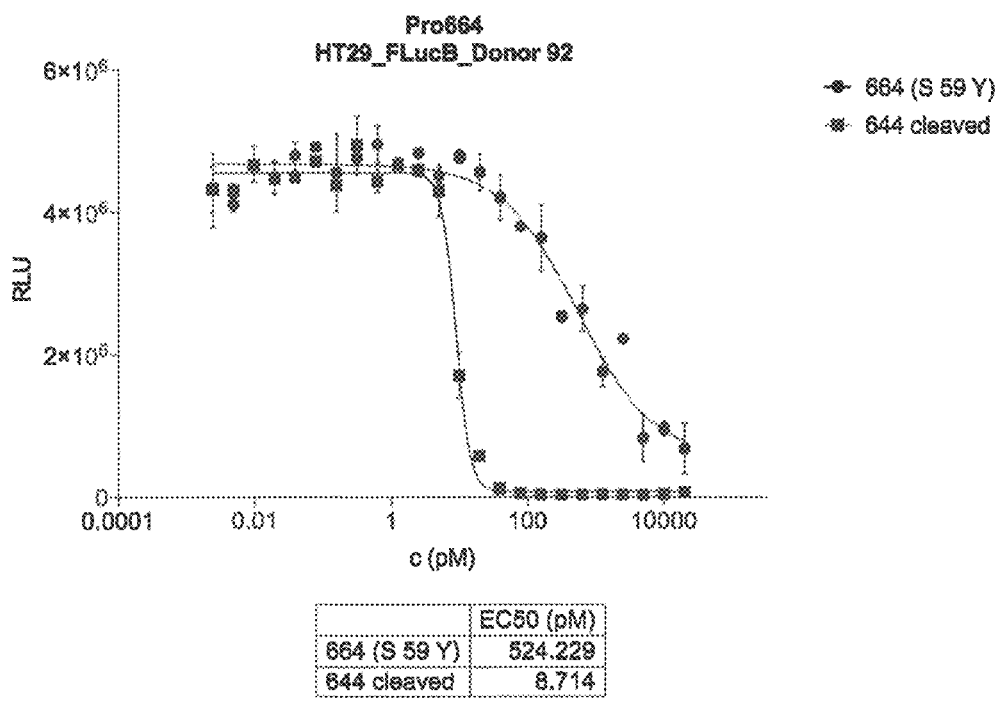
FIG. 89 depicts the results of a TDCC assay using Pro664, which contains an anti-B7H3 hF12 domain with an amino acid variant (S59Y) to remove a glycosylation site as compared to Pro226 (the same construct but without the amino acid variant). The Pro664 shows similar activity to Pro226.
Figure 90:
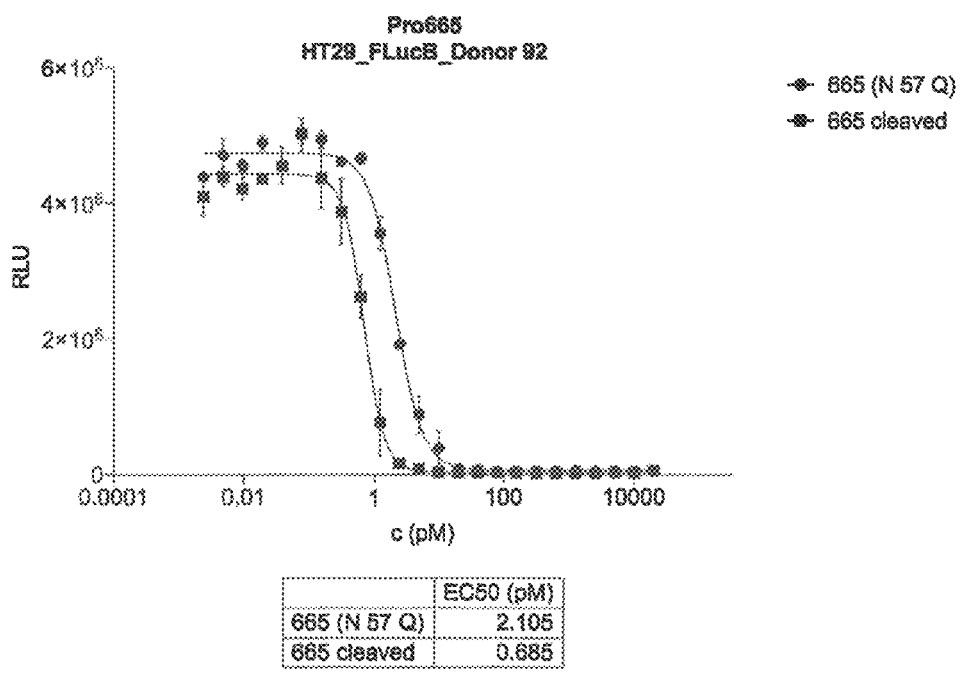
FIG. 90 depicts the results of a TDCC assay using Pro665, which contains an anti-B7H3 hF12 domain with an amino acid variant (N57Q) to remove a glycosylation site as compared to Pro226 (the same construct but without the amino acid variant). The Pro665 shows higher potency than Pro226.
Figure 91:
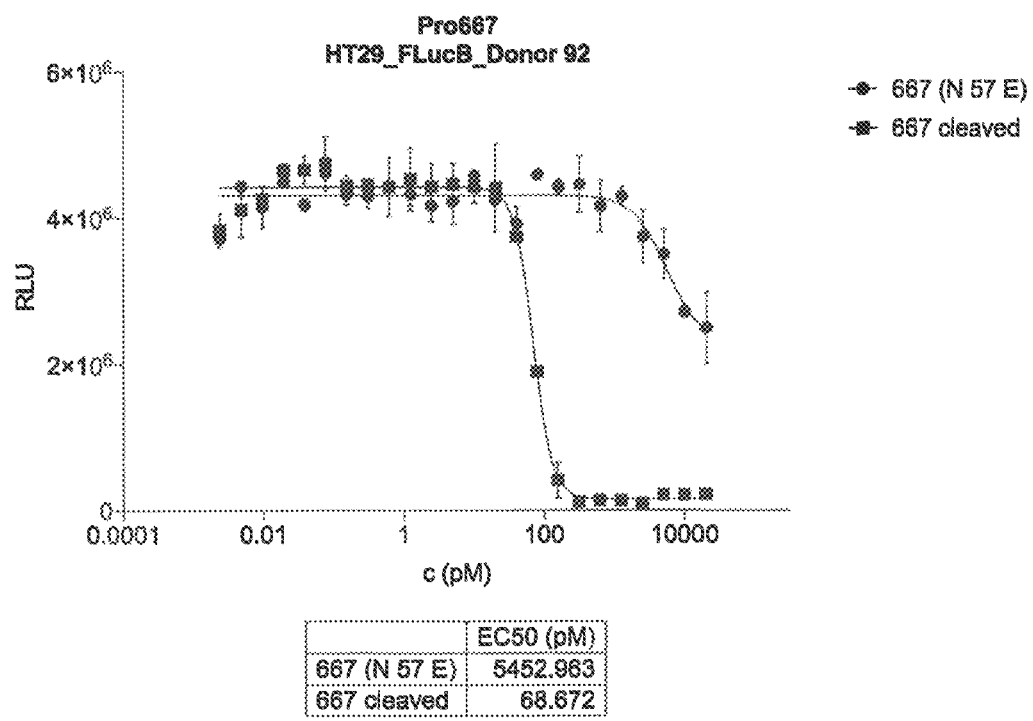
FIG. 91 depicts the results of a TDCC assay using Pro667, which contains an anti-B7H3 hF12 domain with an amino acid variant (N57E) to remove a glycosylation site as compared to Pro226 (the same construct but without the amino acid variant). The Pro667 shows lower potency than Pro226.
Figure 92:
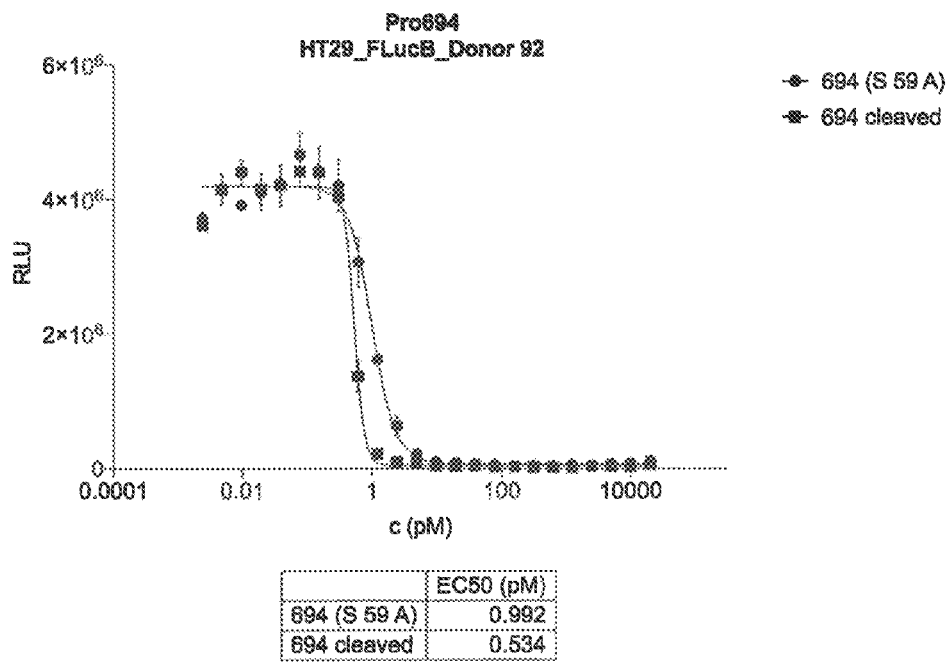
FIG. 92 depicts the results of a TDCC assay using Pro694, which contains an anti-B7H3 hF12 domain with an amino acid variant (S59A) to remove a glycosylation site as compared to Pro226 (the same construct but without the amino acid variant). The Pro694 shows higher potency than Pro226.
Figure 93:
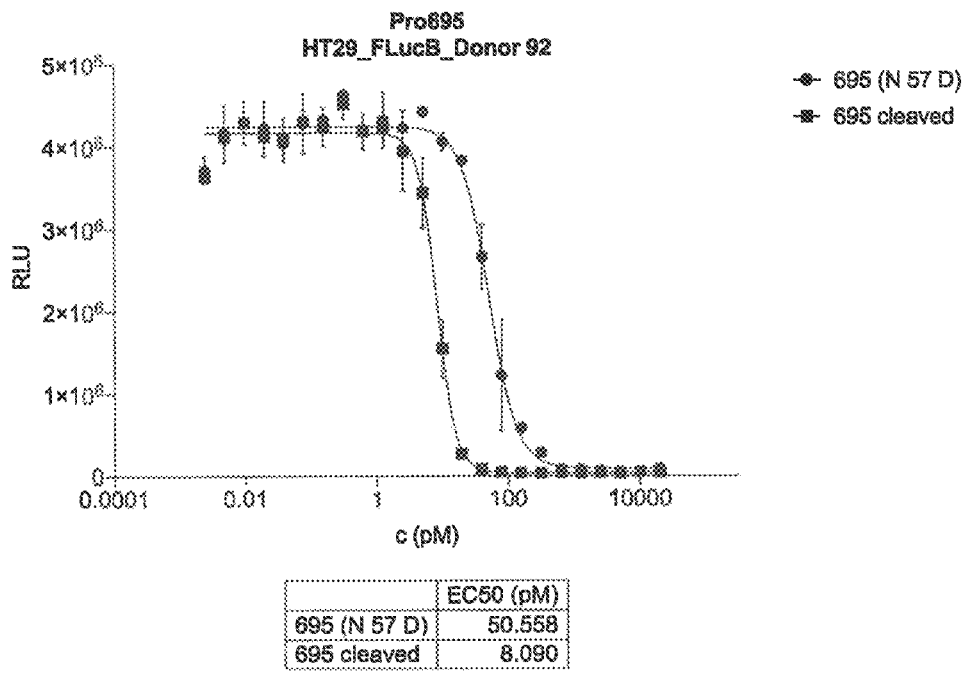
FIG. 93 depicts the results of a TDCC assay using Pro695, which contains an anti-B7H3 hF12 domain with an amino acid variant (N57D) to remove a glycosylation site as compared to Pro226 (the same construct but without the amino acid variant). The Pro695 shows similar potency to Pro226.
Figure 94:
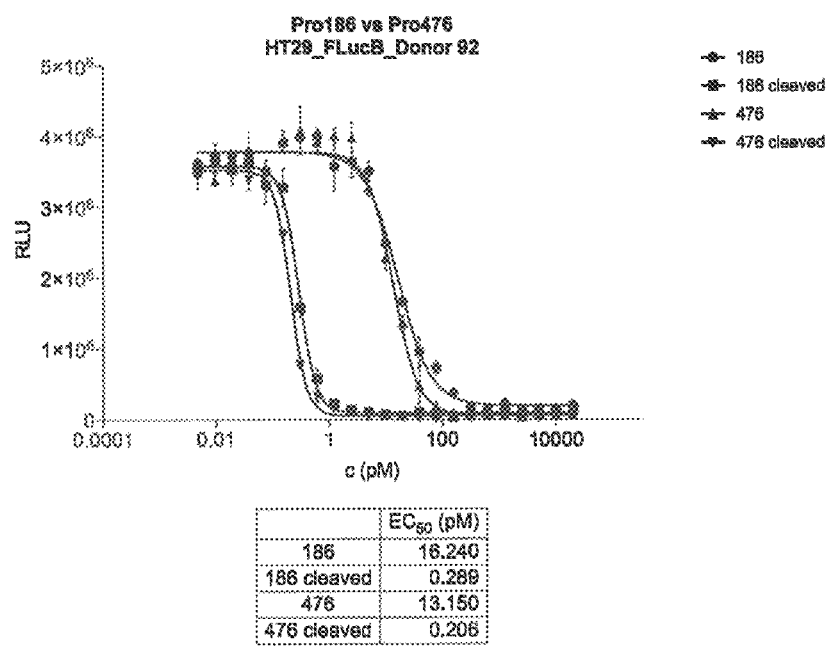
FIG. 94 shows a TDCC assay comparing two different inactivations in the inactive domains. Pro186 has a flag inactivation in both Vhi and Vli and Pro476 has i2 inactivations, and they show similar potency.
Figure 95:
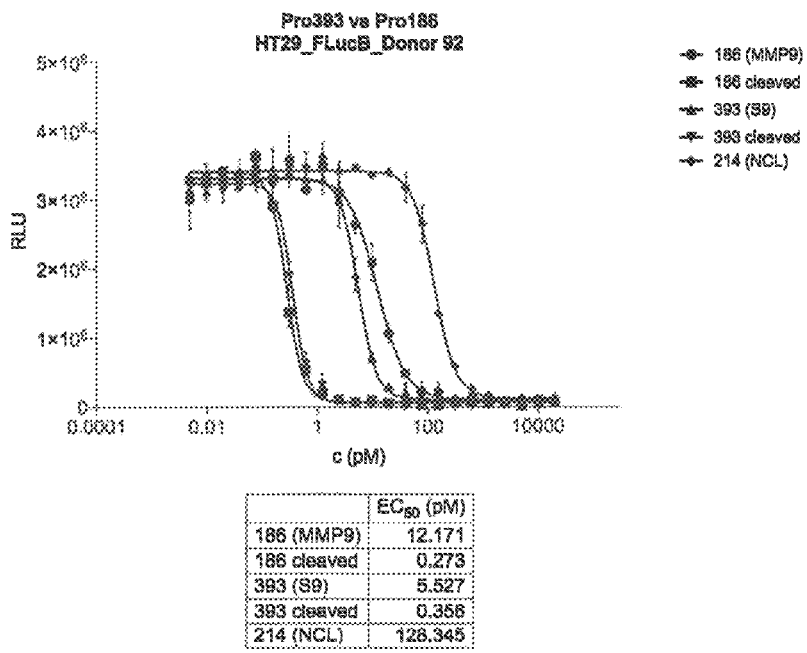
FIG. 95 shows a TDCC assay comparing Pro186, containing an MMP9 cleavage site and Pro393, containing an S9 cleavage site; the results show that both constructs behave similarly with different protease cleavage sites.
Figure 96:
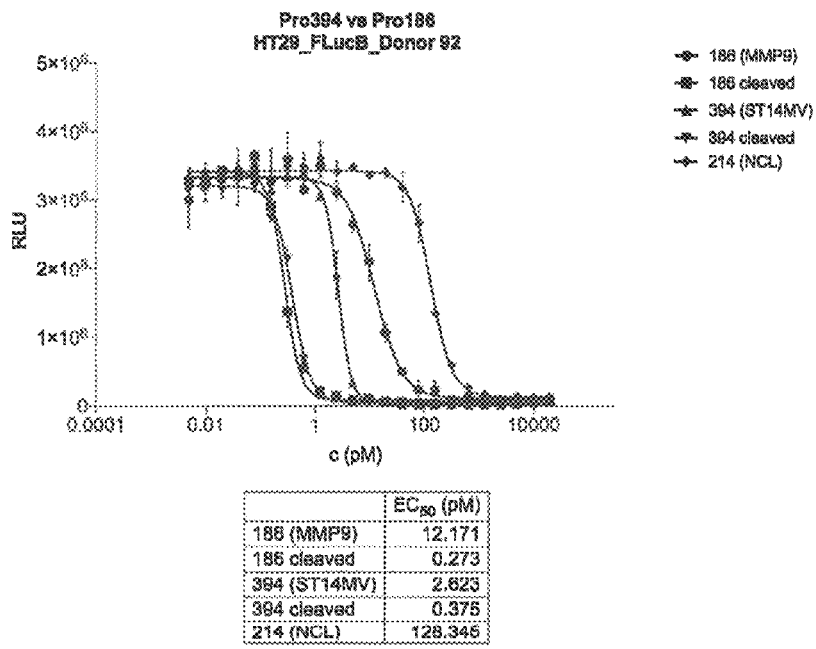
FIG. 96 depicts a TDCC assay comparing Pro186, containing an MMP9 cleavage site and Pro394, containing an ST14 MV cleavage site; the results show that both constructs behave similarly with different protease cleavage sites.
Figure 97:
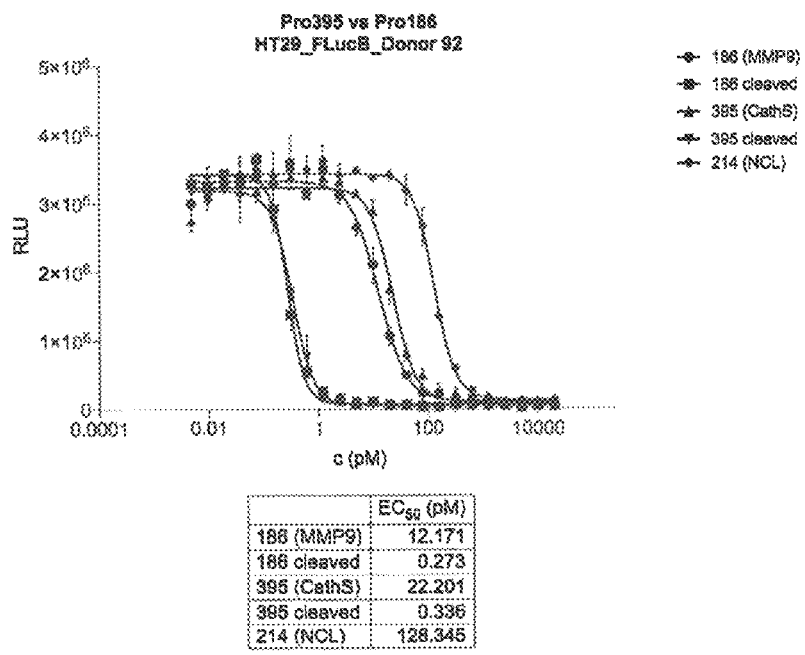
FIG. 97 depicts a TDCC assay comparing Pro186, containing an MMP9 cleavage site and Pro395, containing an CathS cleavage site; the results show that both constructs behave similarly with different protease cleavage sites.
Figure 98:
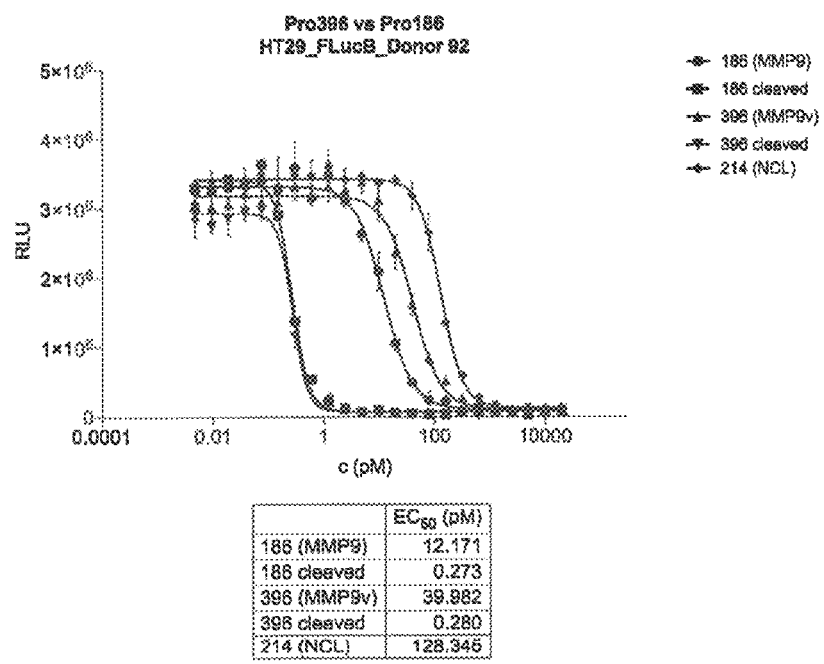
FIG. 98 depicts a TDCC assay comparing Pro186, containing an MMP9 cleavage site and Pro396, containing an MMP9v cleavage site; the results show that both constructs behave similarly with different protease linker sequences. Note that MMP9 site is cleaved by both MMP9 and CathS, while MMP9v is MMP9 specific.
Figure 99:
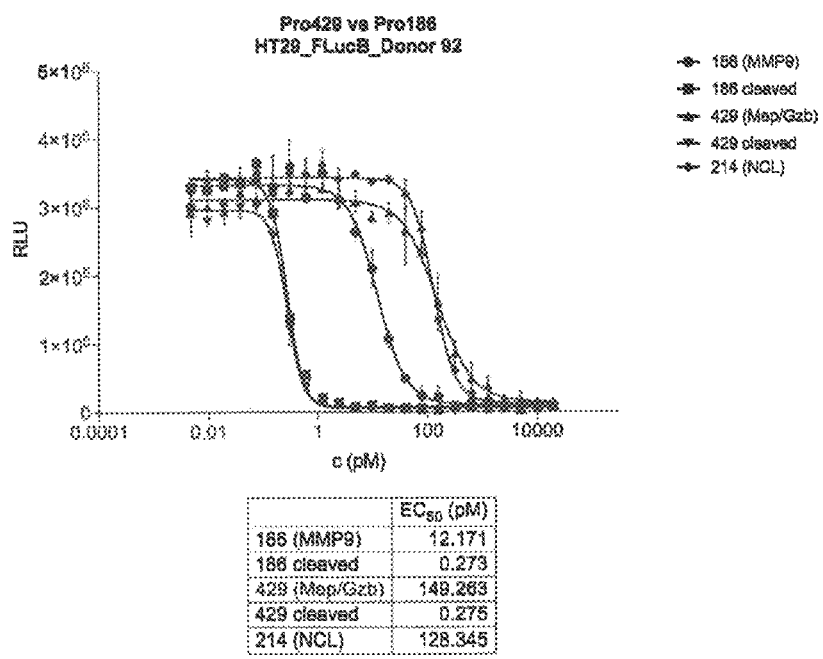
FIG. 99 depicts a TDCC assay comparing Pro186, containing an MMP9 cleavage site and Pro429, containing a MepGzb cleavage site; the results show that both constructs behave similarly with different protease cleavage sites.
Figure 100:
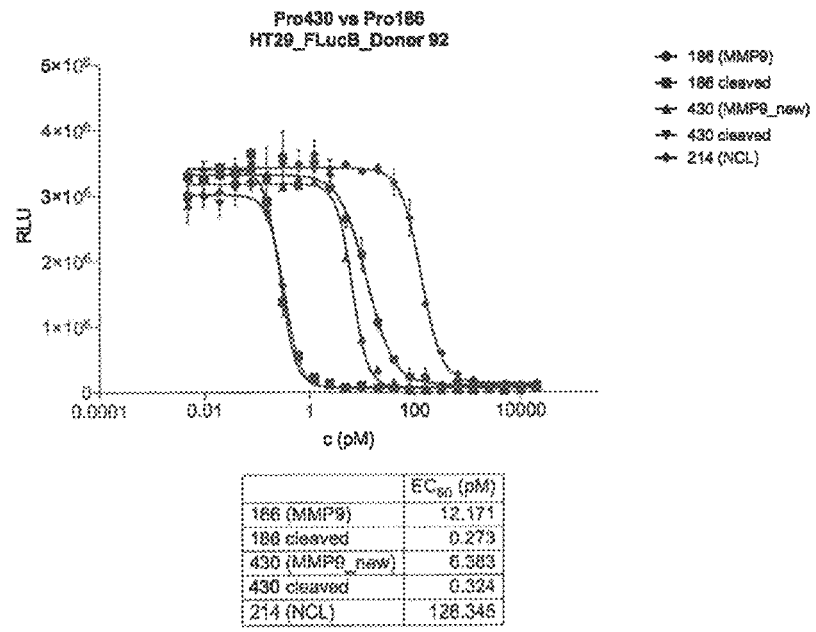
FIG. 100 depicts a TDCC assay comparing Pro186, containing an MMP9 cleavage site and Pro430, containing an MMP9-2 cleavage site; they behave similarly although the MMP9 cleavage sites are different.
Figure 101:
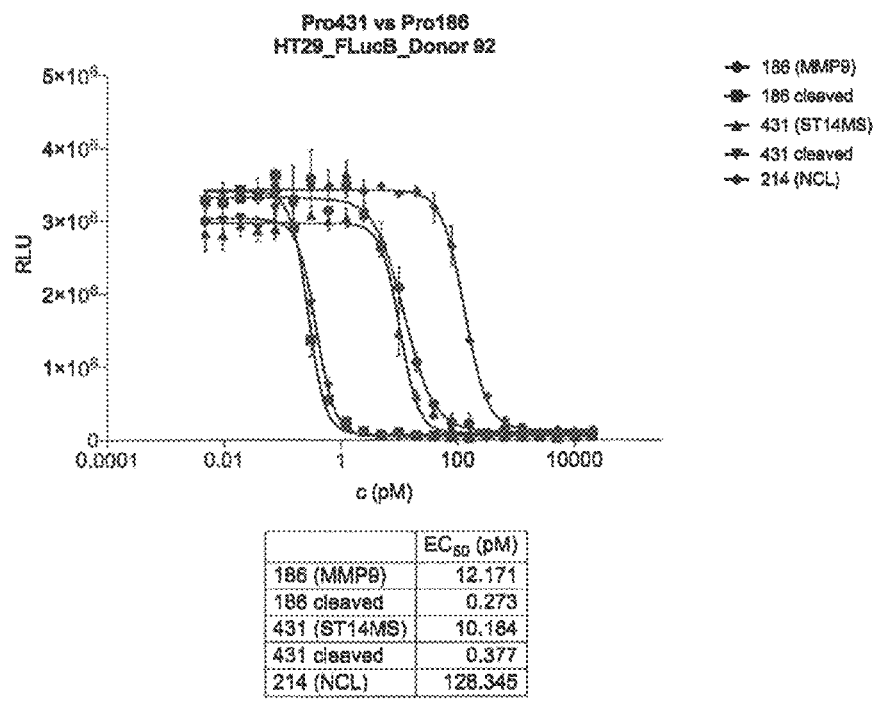
FIG. 101 depicts a TDCC assay comparing Pro186, containing an MMP9 cleavage site and Pro431, containing an ST14 MS cleavage site; the results show that both constructs behave similarly with different protease cleavage sites.
Figure 102:
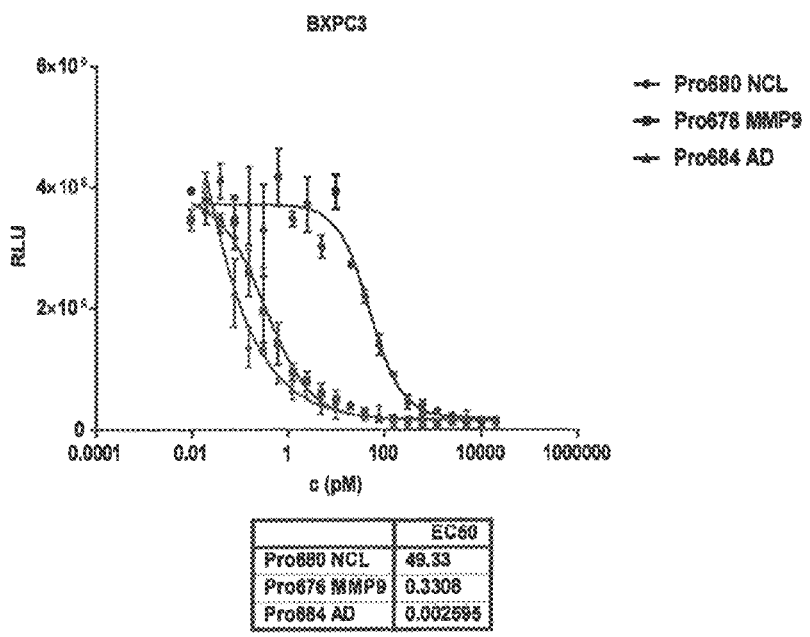
FIG. 102 depicts a TDCC assay using Pro676, a Trop2 containing construct, showing that Pro677 and its active dimer (Pro684AD) show more activity against BXPC3 tumor cells than Pro680, the noncleavable control. The active dimer is made by expressing the active domain that self-dimerizes.
Figure 103:
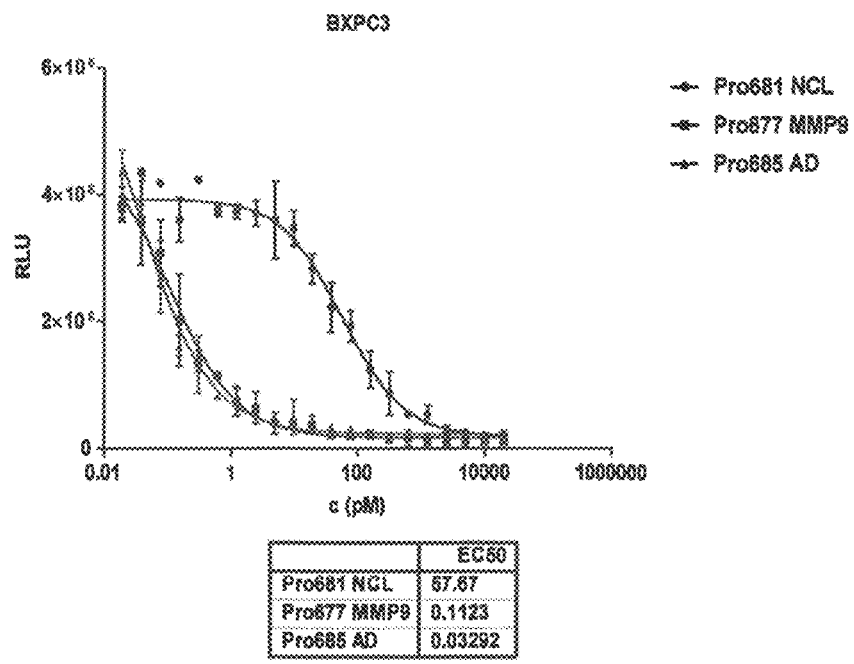
FIG. 103 depicts a TDCC assay using Pro677, a Trop2 containing construct, showing that Pro677 and its active dimer (Pro685AD) show more activity against BXPC3 tumor cells than Pro681, the noncleavable control
Figure 104:
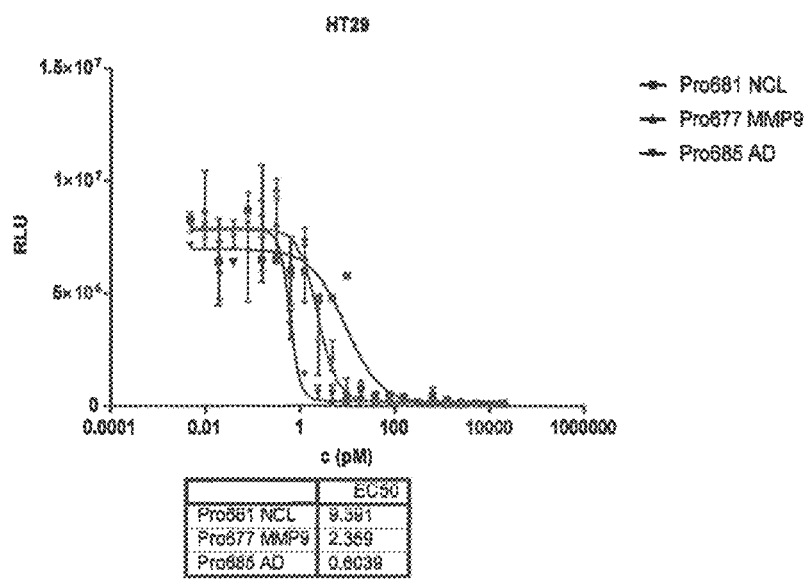
FIG. 104 depicts a TDCC assay using Pro677, a Trop2 containing construct, showing that Pro677 and its active dimer (Pro685AD) show more activity against HT29 tumor cells than Pro681, the noncleavable control. The Pro677 shows less activation by the HT29 cells than BXPC3 cells.
Figure 105:
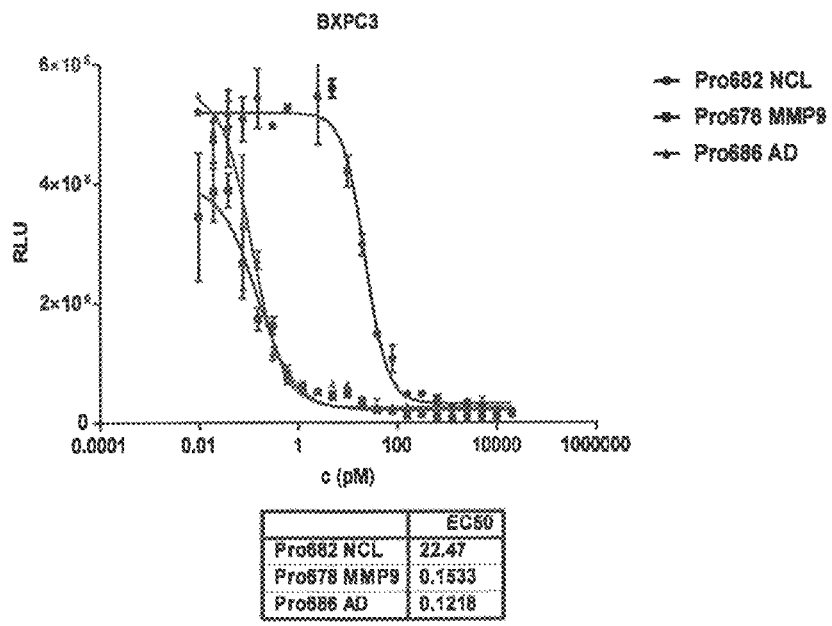
FIG. 105 depicts a TDCC assay using Pro678, a Trop2 containing construct, showing that Pro678 and its active dimer (Pro686AD) show more activity against BXPC3 tumor cells than Pro682, the noncleavable control.
Figure 106:
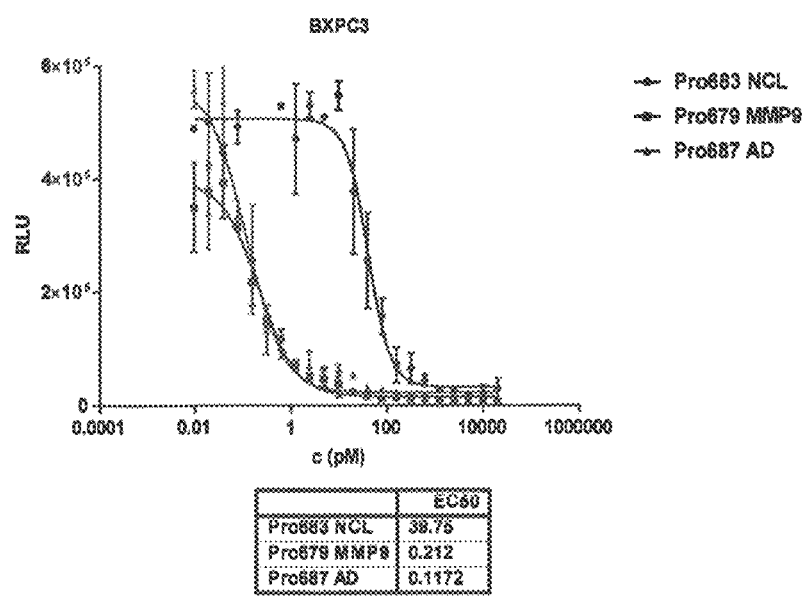
FIG. 106 depicts a TDCC assay using Pro679, a Trop2 containing construct, showing that Pro679 and its active dimer (Pro687 active domain, AD) show more activity against BXPC3 tumor cells than Pro683, the noncleavable control.
Figure 107:
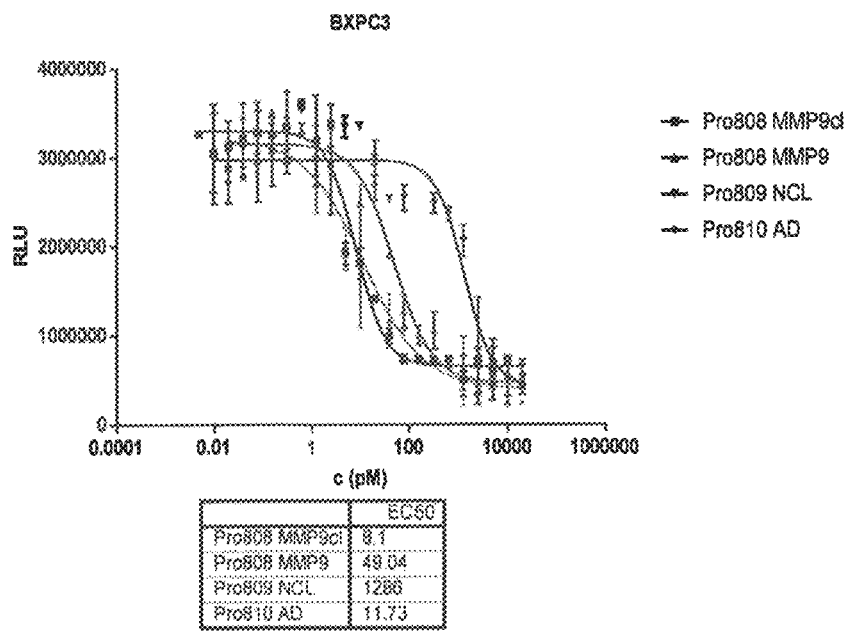
FIG. 107 depicts a TDCC assay using Pro808, a Trop2 containing construct, showing that Pro808, its cleaved form and the active dimer (Pro810AD) show more activity against BXPC3 tumor cells than Pro809, the noncleavable control.
Figure 108:
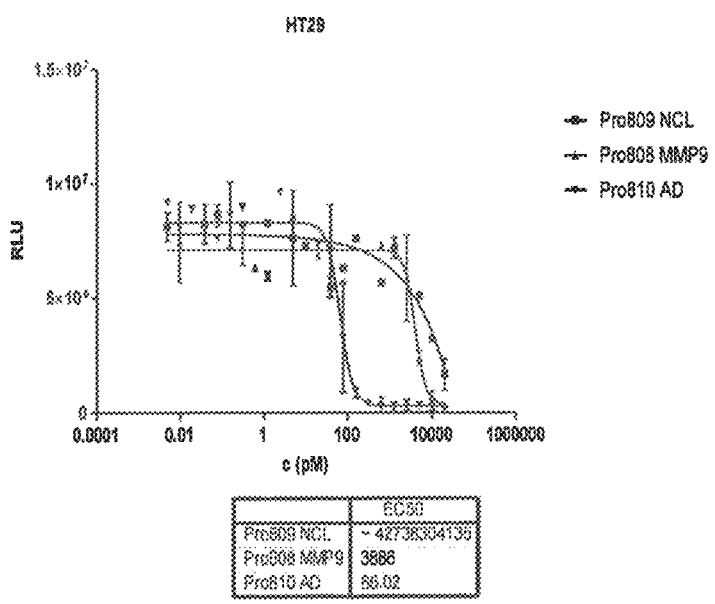
FIG. 108 depicts a TDCC assay using Pro808, a Trop2 containing construct in HT29 tumor cells. The Pro810AD (active domain) shows more activity in a TDCC assay than Pro809, the noncleavable control. The full length Pro808 does not show much activation in the assay with HT29 cells.
Figure 109:
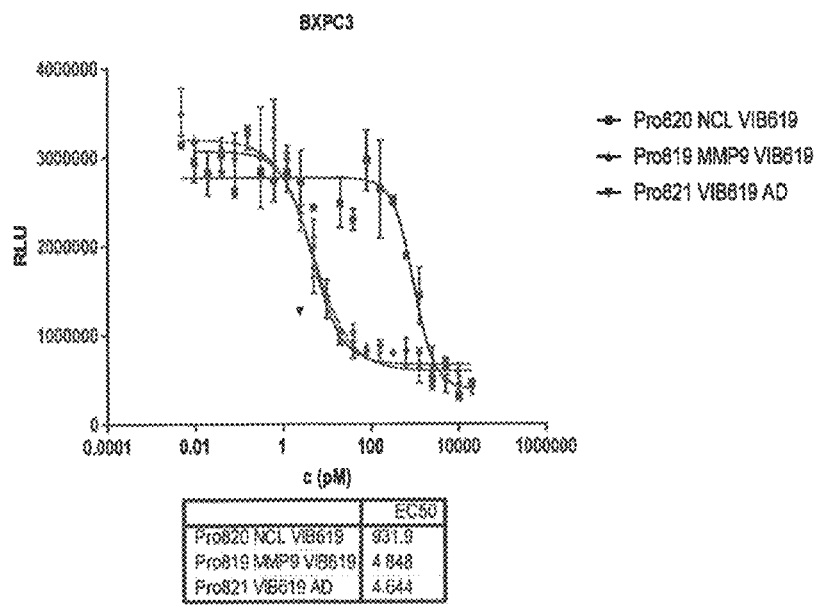
FIG. 109 depicts a TDCC assay using Pro819, a Trop2 containing construct, showing that Pro819 and its active dimer (Pro821AD) show more activity against BXPC3 tumor cells than Pro820, the noncleavable control.
Figure 110:
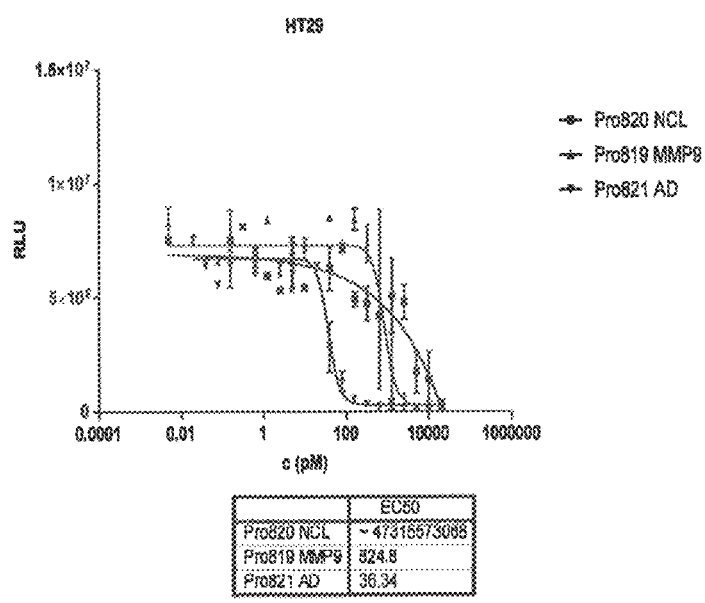
FIG. 110 depicts a TDCC assay using Pro819, a Trop2 containing construct, showing that the active dimer (Pro821AD) show more activity than the noncleavable control. The full length Pro819 does not show much activation by the HT29 cells when compared to the non-cleavable control, Pro820. For both pairs of FIGS. 107 and 108, as well as, FIGS. 109 and 110, the data suggests that different target cell types are producing different levels of MMP activity when taken in conjunction with the data showing that the addition of an MMP9 inhibitor reduces activity (see FIG. 133).
Figure 111:
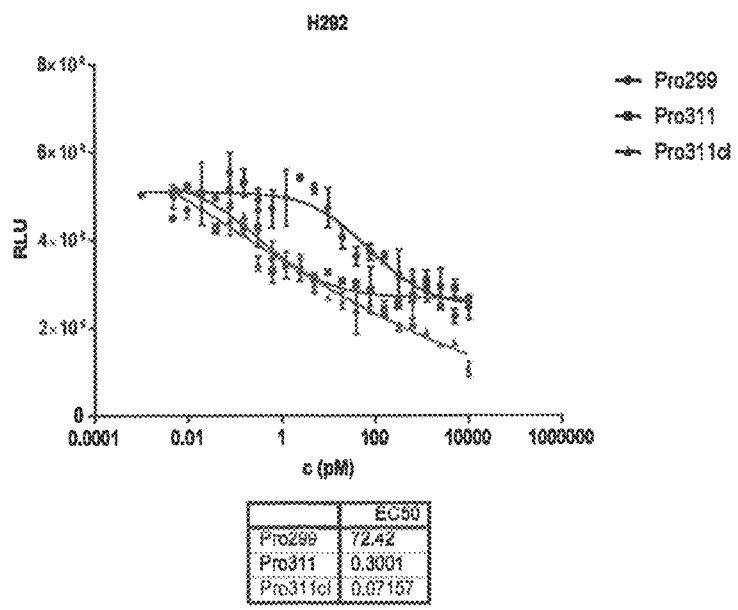
FIG. 111 depicts a TDCC assay using Pro311, a FOLR1 construct, showing that Pro311 and Pro311 cleaved by MMP9 shows more activity than Pro299 noncleavable control against H292 tumor cells.
Figure 112:
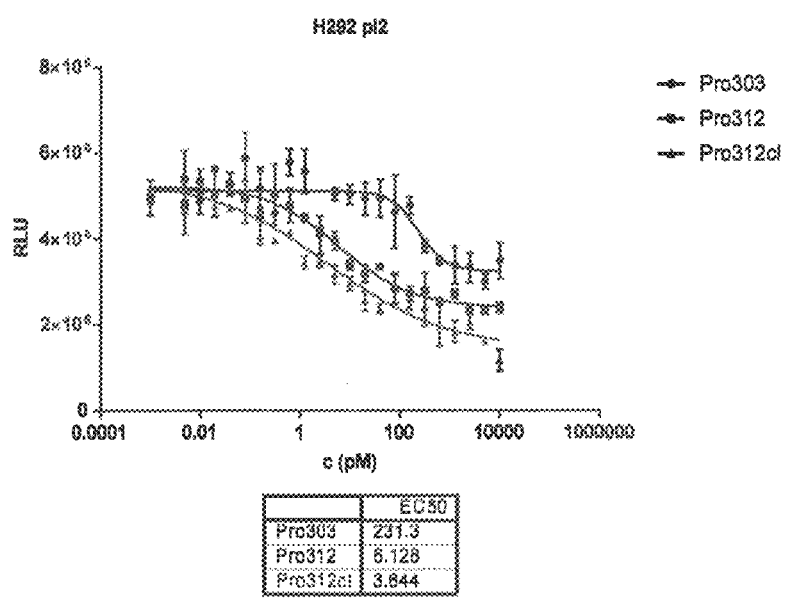
FIG. 112 depicts a TDCC assay using Pro312, a FOLR1 construct, showing that Pro312 and Pro312 cleaved by MMP9 shows more activity than Pro303 noncleavable control against H292 tumor cells.
Figure 113:
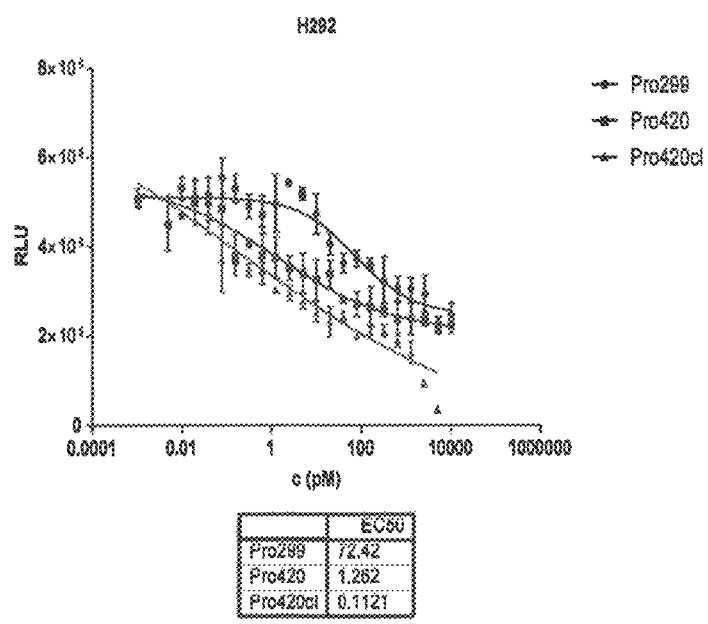
FIG. 113 depicts the results of a TDCC assay using a dual targeting construct, Pro420, which has FOLR1 and EGFR targeting. The results show that Pro420 and Pro420 cleaved with MMP9, show more activity than Pro299, the noncleavable control.
Figure 114:
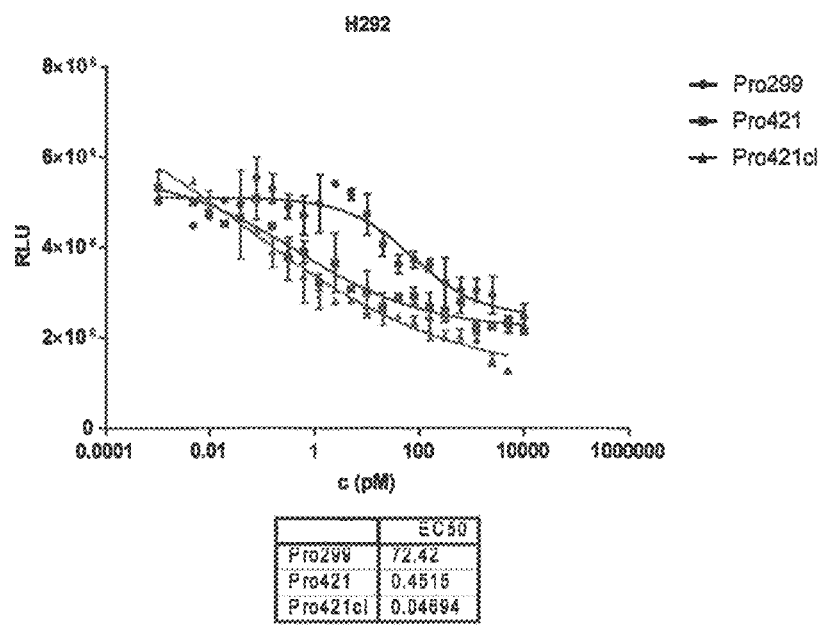
FIG. 114 depicts the results of a TDCC assay using a dual targeting construct, Pro421, which has FOLR1 and EGFR targeting (in reverse orientation from Pro420). The results show that Pro421 and Pro421 cleaved with MMP9, show more activity than Pro299, the non-cleavable control.
Figure 115:
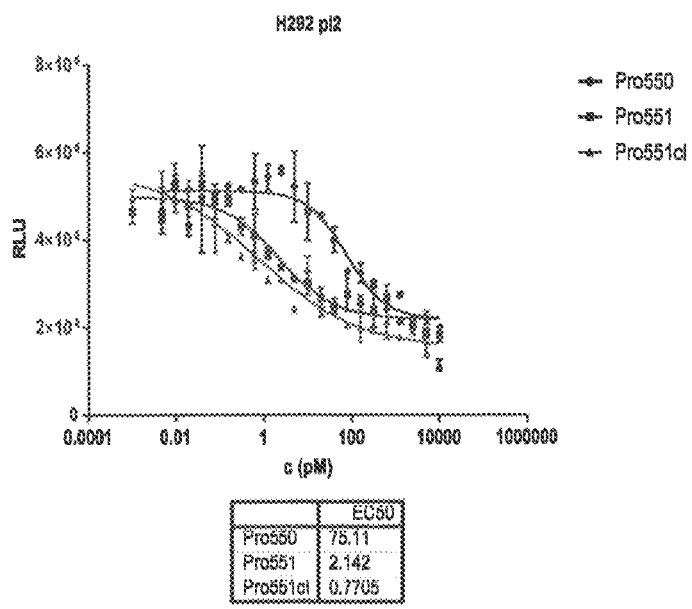
FIG. 115 depicts the results of a TDCC assay using a dual targeting construct, Pro551, which has EGFR and FOLR1 targeting. The results show that Pro551 and Pro551 cleaved with MMP9, show more activity than Pro550, the non-cleavable control.
Figure 116:
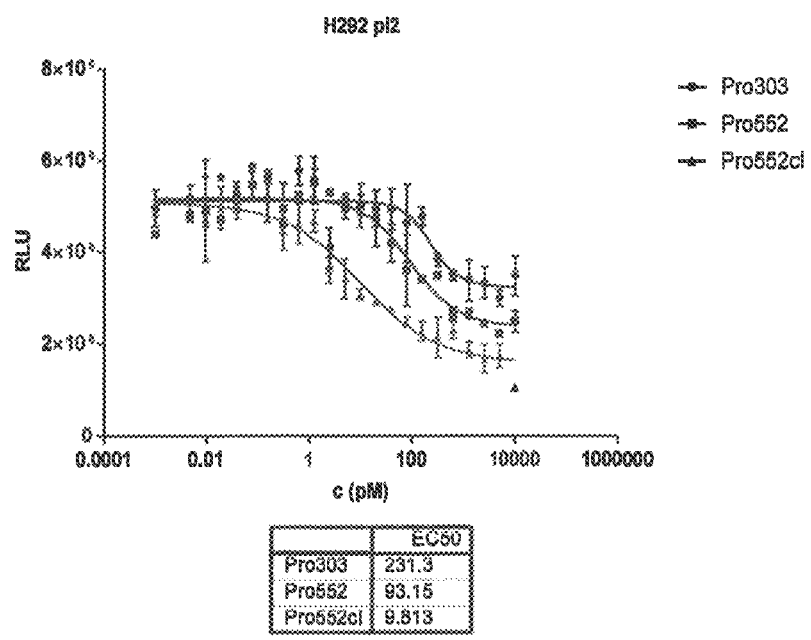
FIG. 116 depicts the results of a TDCC assay using a dual targeting construct, Pro552, which has FOLR1 and EGFR targeting (in reverse orientation from Pro551). The results show that Pro522 and Pro522 cleaved with MMP9, show more activity than Pro303, the non-cleavable control.
Figure 117:
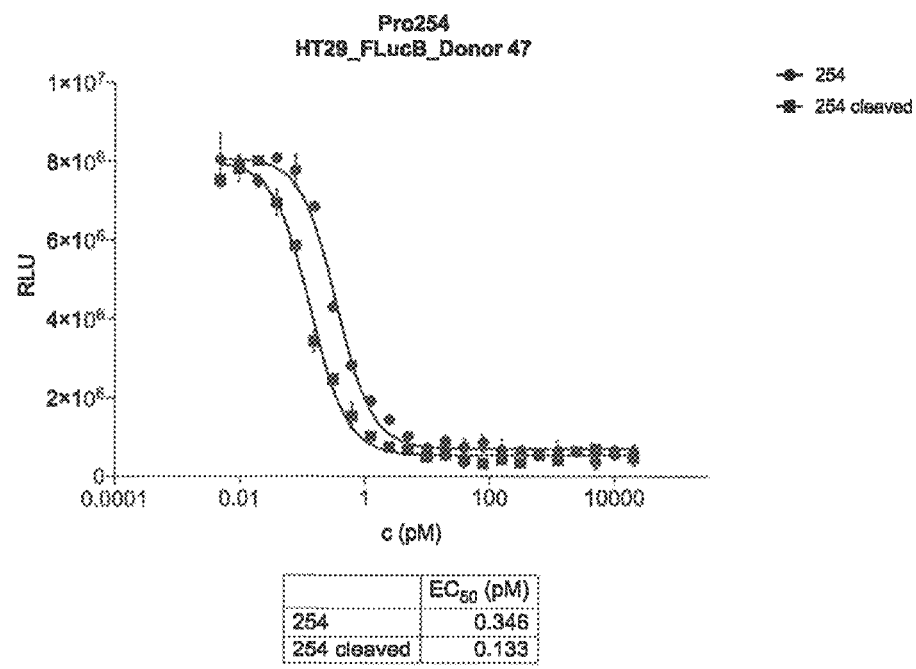
FIG. 117 depicts the results of a TDCC assay using a dual targeting construct Pro254 wherein each targeting domain binds to a different epitope of EGFR, and it is potent against EGFR expressing HT29 cells.
Figure 118:
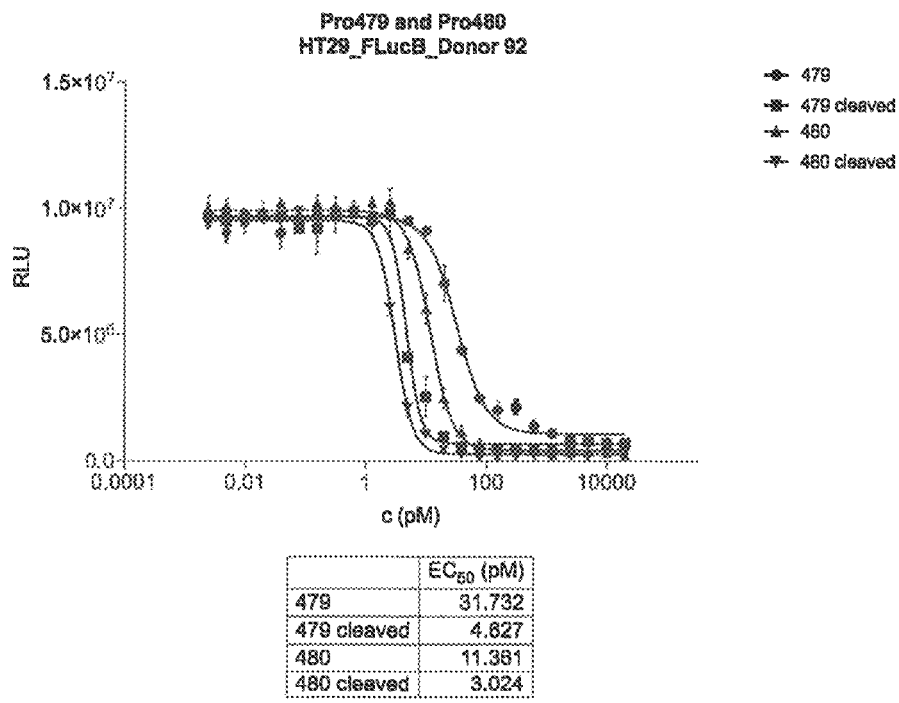
FIG. 118 depicts the results of a TDCC assay using two different dual targeting constructs that also use two different targeting domains but both bind to B7H3. Pro479 and Pro480 are identical except for the orientation of the two binding domains, and both show activity after cleavage by MMP9 on B7H3 expressing HT29 cells.
Figure 119:
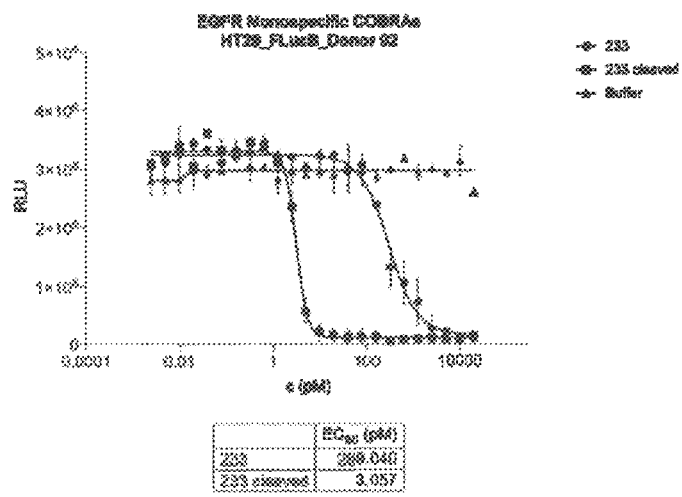
FIG. 119 depicts the results of a TDCC assay using Pro233 and Pro233 cleaved on EGFR-expressing HT-29 cells. Pro233 shows good conditionality and good potency when cleaved with MMP9.

FIG. 74A-FIG. 74B shows that cleaved PRO186 clears more rapidly than intact (uncleaved) PRO186. FIG. 74A shows pharmacokinetics of the test articles in plasma of non-tumor bearing mice. FIG. 74B shows tumor volume of LoVo-derived tumors in mice administered the test articles.

Conclusions: We have designed a multivalent sdAb-diabody fusion which converts into a highly potent bispecific redirected T-cell therapeutic upon proteolytic action. In vitro assay demonstrated that protease dependent linker cleavage increased potency of T cell-mediated killing by 200-fold, thus yielding a therapeutic with sub-picomolar potency. Administration of PRO186 (Pro186) in mice with established xenografts resulted in protease cleavage dependent T cell-mediated tumor regressions in multiple tumor models. PRO186 displayed (1) extended half-life in vivo upon administration and (2) rapid clearance post proteolytic activation, thereby demonstrating PRO186 to be a therapeutic with improved safety profile over conventional T-cell redirected bispecifics.

SEQUENCE LISTING (335 sequences)

SEQ ID NO: 1 - protein, 127 aa, Artificial Sequence
  Synthetic antigen binding domain -Targeting sdAbs - alpha-EGFR1
EVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSS

SEQ ID NO: 2 - protein, 10 aa, Artificial Sequence
  Synthetic sdCDR1 -Targeting sdAbs - alpha-EGFR1
GRTFSSYAMG

SEQ ID NO: 3 - protein, 16 aa, Artificial Sequence
  Synthetic sdCDR2 -Targeting sdAbs - alpha-EGFR1
INWSSGSTYYADSVKG

SEQ ID NO: 4 - protein, 18 aa, Artificial Sequence
  Synthetic sdCDR3 - Targeting sdAbs - alpha-EGFR1
GYQINSGNYNFKDYEYDY

SEQ ID NO: 5 - protein, 124 aa, Artificial Sequence
  Synthetic antigen binding domain -Targeting sdAbs - alpha-EGFR2
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 6 - protein, 10 aa, Artificial Sequence
  Synthetic sdCDR1 -Targeting sdAbs - alpha-EGFR2
GRTSRSYGMG

SEQ ID NO: 7 - protein, 17 aa, Artificial Sequence
  Synthetic sdCDR2 -Targeting sdAbs - alpha-EGFR2
GISWRGDSTGYADSVKG

SEQ ID NO: 8 - protein, 15 aa, Artificial Sequence
  Synthetic sdCDR3 -Targeting sdAbs - alpha-EGFR2
AAGSAWYGTLYEYDY

SEQ ID NO: 9 - protein, 127 aa, Artificial Sequence
  Synthetic antigen binding domain -Targeting sdAbs - h-alpha-EGFR1
EVQLVESGGGLVQPGGSLRLSCAASGRTFSSYAMGWFRQAPGKEREFVVAINWSSGSTYYADSVKGRFTISRDNSKNTLYLQMNSLRAEDTAVYYCAAGYQINSGNYNFKDYEYDYWGQGTLVTVSS

SEQ ID NO: 10 - protein, 10 aa, Artificial Sequence
  Synthetic sdCDR1 -Targeting sdAbs - h-alpha-EGFR1
GRTFSSYAMG

SEQ ID NO: 11 - protein, 16 aa, Artificial Sequence
  Synthetic sdCDR2 -Targeting sdAbs - h-alpha-EGFR1
INWSSGSTYYADSVKG

SEQ ID NO: 12 - protein, 18 aa, Artificial Sequence
  Synthetic sdCDR3 -Targeting sdAbs - h-alpha-EGFR1
GYQINSGNYNFKDYEYDY

SEQ ID NO: 13 - protein, 124 aa, Artificial Sequence
  Synthetic antigen binding domain -Targeting sdAbs - aEGFR2a sdAb
EVQLVESGGGVVRPGGSLRLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSS

SEQ ID NO: 14 - protein, 10 aa, Artificial Sequence
  Synthetic sdCDR1 -Targeting sdAbs - aEGFR2a sdAb
GRTSRSYGMG

SEQ ID NO: 15 - protein, 17 aa, Artificial Sequence
  Synthetic sdCDR2 -Targeting sdAbs - aEGFR2a sdAb
GISWRGDSTGYADSVKG

SEQ ID NO: 16 - protein, 15 aa, Artificial Sequence
  Synthetic sdCDR3 -Targeting sdAbs - aEGFR2a sdAb
AAGSAWYGTLYEYDY

SEQ ID NO: 17 - protein, 124 aa, Artificial Sequence
  Synthetic antigen binding domain -Targeting sdAbs - h-alpha-EGFR2
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSS

SEQ ID NO: 18 - protein, 10 aa, Artificial Sequence
  Synthetic sdCDR1 -Targeting sdAbs - h-alpha-EGFR2
GRTSRSYGMG

SEQ ID NO: 19 - protein, 17 aa, Artificial Sequence
  Synthetic sdCDR2 -Targeting sdAbs - h-alpha-EGFR2
GISWRGDSTGYADSVKG

SEQ ID NO: 20 - protein, 15 aa, Artificial Sequence
  Synthetic sdCDR3 -Targeting sdAbs - h-alpha-EGFR2
AAGSAWYGTLYEYDY

SEQ ID NO: 21 - protein, 114 aa, Artificial Sequence
  Synthetic antigen binding domain -Targeting sdAbs - alpha-FOLR1 h77-2
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSS

SEQ ID NO: 22 - protein, 10 aa, Artificial Sequence
  Synthetic sdCDR1 -Targeting sdAbs - alpha-FOLR1 h77-2
GFTVSNSVMA

SEQ ID NO: 23 - protein, 16 aa, Artificial Sequence
  Synthetic sdCDR2 -Targeting sdAbs - alpha-FOLR1 h77-2
IINSIGITNYADSVKG

SEQ ID NO: 24 - protein, 6 aa, Artificial Sequence
  Synthetic sdCDR3 -Targeting sdAbs - alpha-FOLR1 h77-2
NFDRIY

SEQ ID NO: 25 - protein, 113 aa, Artificial Sequence
  Synthetic antigen binding domain -Targeting sdAbs - alpha-FOLR1 h59.3
QVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSS

SEQ ID NO: 26 - protein, 10 aa, Artificial Sequence
  Synthetic sdCDR1 -Targeting sdAbs - alpha-FOLR1 h59.3
GNTFSISAMG

SEQ ID NO: 27 - protein, 16 aa, Artificial Sequence
  Synthetic sdCDR2 -Targeting sdAbs - alpha-FOLR1 h59.3
VTHSDYSTNYADSVKG

SEQ ID NO: 28 - protein, 5 aa, Artificial Sequence
  Synthetic sdCDR3 -Targeting sdAbs - alpha-FOLR1 h59.3
YGIDY

SEQ ID NO: 29 - protein, 117 aa, Artificial Sequence
  Synthetic antigen binding domain -Targeting sdAbs - alpha-FOLR1 h22-4
QVQLVESGGGLVQPGGSLRLSCEASGTTFSRDVMGWYRQAPGKQRELVAIISRGGSTNYADSVKGRFTISRDNSKNTLYLQMNSLRAEDTAVYYCNANTATWGRVFWGQGTLVTVSS

SEQ ID NO: 30 - protein, 10 aa, Artificial Sequence
  Synthetic sdCDR1 -Targeting sdAbs - alpha-FOLR1 h22-4
GTTFSRDVMG

SEQ ID NO: 31 - protein, 16 aa, Artificial Sequence
  Synthetic sdCDR2 -Targeting sdAbs - alpha-FOLR1 h22-4
IISRGGSTNYADSVKG

SEQ ID NO: 32 - protein, 9 aa, Artificial Sequence
  Synthetic sdCDR3 -Targeting sdAbs - alpha-FOLR1 h22-4
NTATWGRVF

SEQ ID NO: 33 - protein, 124 aa, Artificial Sequence
  Synthetic antigen binding domain -Targeting sdAbs - alpha-B7H3 hF7
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSS

SEQ ID NO: 34 - protein, 10 aa, Artificial Sequence
  Synthetic sdCDR1 -Targeting sdAbs - alpha-B7H3 hF7
RRTFHTYHMG

SEQ ID NO: 35 - protein, 17 aa, Artificial Sequence
  Synthetic sdCDR2 -Targeting sdAbs - alpha-B7H3 hF7
VINWSGGSTVYADSVKG

SEQ ID NO: 36 - protein, 15 aa, Artificial Sequence
  Synthetic sdCDR3 -Targeting sdAbs - alpha-B7H3 hF7
GGATTQRATEASYDY

SEQ ID NO: 37 - protein, 122 aa, Artificial Sequence
  Synthetic antigen binding domain -Targeting sdAbs - alpha-B7H3 hF12
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSS

SEQ ID NO: 38 - protein, 10 aa, Artificial Sequence
  Synthetic sdCDR1 -Targeting sdAbs - alpha-B7H3 hF12
PRTFSTYSMA

SEQ ID NO: 39 - protein, 17 aa, Artificial Sequence
  Synthetic sdCDR2 -Targeting sdAbs - alpha-B7H3 hF12
AINWSGGNTSYADSVKG

SEQ ID NO: 40 - protein, 13 aa, Artificial Sequence
  Synthetic sdCDR3 -Targeting sdAbs - alpha-B7H3 hF12
GGVLAHHNYEYDY

SEQ ID NO: 41 - protein, 122 aa, Artificial Sequence
  Synthetic antigen binding domain -Targeting sdAbs - alpha-B7H3 hF12 - (N57Q)
QVQLQESGGGLVQPGGSLRLSCEASPRTFSTYSMAWFRQAPGKERSFVAAINWSGGQTSYADSVKGRFTISRDNSKNTLYLQMNSLRAEDTAVYYCAAGGVLAHHNYEYDYWGQGTLVTVSS

SEQ ID NO: 42 - protein, 10 aa, Artificial Sequence
  Synthetic sdCDR1 -Targeting sdAbs - alpha-B7H3 hF12 - (N57Q)
PRTFSTYSMA

SEQ ID NO: 43 - protein, 17 aa, Artificial Sequence
  Synthetic sdCDR2 -Targeting sdAbs - alpha-B7H3 hF12 - (N57Q)
AINWSGGQTSYADSVKG

SEQ ID NO: 44 - protein, 13 aa, Artificial Sequence
  Synthetic sdCDR3 -Targeting sdAbs - alpha-B7H3 hF12 - (N57Q)
GGVLAHHNYEYDY

SEQ ID NO: 45 - protein, 122 aa, Artificial Sequence
  Synthetic antigen binding domain -Targeting sdAbs - alpha-B7H3 hF12 - (N57E)
QVQLQESGGGLVQPGGSLRLSCEASPRTFSTYSMAWFRQAPGKERSFVAAINWSGGETSYADSVKGRFTISRDNSKNTLYLQMNSLRAEDTAVYYCAAGGVLAHHNYEYDYWGQGTLVTVSS

SEQ ID NO: 46 - protein, 10 aa, Artificial Sequence
  Synthetic sdCDR1-Targeting sdAbs - alpha-B7H3 hF12 - (N57E)
PRTFSTYSMA

SEQ ID NO: 47 - protein, 17 aa, Artificial Sequence
  Synthetic sdCDR2-Targeting sdAbs - alpha-B7H3 hF12 - (N57E)
AINWSGGETSYADSVKG

SEQ ID NO: 48 - protein, 13 aa, Artificial Sequence
  Synthetic sdCDR3-Targeting sdAbs - alpha-B7H3 hF12 - (N57E)
GGVLAHHNYEYDY

SEQ ID NO: 49 - protein, 122 aa, Artificial Sequence
  Synthetic antigen binding domain -Targeting sdAbs - alpha-B7H3 hF12 - (N57D)
QVQLQESGGGLVQPGGSLRLSCEASPRTFSTYSMAWFRQAPGKERSFVAAINWSGGDTSYADSVKGRFTISRDNSKNTLYLQMNSLRAEDTAVYYCAAGGVLAHHNYEYDYWGQGTLVTVSS

SEQ ID NO: 50 - protein, 10 aa, Artificial Sequence
  Synthetic sdCDR1-Targeting sdAbs - alpha-B7H3 hF12 - (N57D)
PRTFSTYSMA

SEQ ID NO: 51 - protein, 17 aa, Artificial Sequence
  Synthetic sdCDR2-Targeting sdAbs - alpha-B7H3 hF12 - (N57D)
AINWSGGDTSYADSVKG

SEQ ID NO: 52 - protein, 13 aa, Artificial Sequence
  Synthetic sdCDR3-Targeting sdAbs - alpha-B7H3 hF12 - (N57D)
GGVLAHHNYEYDY

SEQ ID NO: 53 - protein, 122 aa, Artificial Sequence
  Synthetic antigen binding domain -Targeting sdAbs - alpha-B7H3 hF12 - (S59A)
QVQLQESGGGLVQPGGSLRLSCEASPRTFSTYSMAWFRQAPGKERSFVAAINWSGGNTAYADSVKGRFTISRDNSKNTLYLQMNSLRAEDTAVYYCAAGGVLAHHNYEYDYWGQGTLVTVSS

SEQ ID NO: 54 - protein, 10 aa, Artificial Sequence
  Synthetic sdCDR1-Targeting sdAbs - alpha-B7H3 hF12 - (S59A)
PRTFSTYSMA

SEQ ID NO: 55 - protein, 17 aa, Artificial Sequence
  Synthetic sdCDR2-Targeting sdAbs - alpha-B7H3 hF12 - (S59A)
AINWSGGNTAYADSVKG

SEQ ID NO: 56 - protein, 13 aa, Artificial Sequence
  Synthetic sdCDR3-Targeting sdAbs - alpha-B7H3 hF12 - (S59A)
GGVLAHHNYEYDY

SEQ ID NO: 57 - protein, 122 aa, Artificial Sequence
  Synthetic antigen binding domain -Targeting sdAbs - alpha-B7H3 hF12 - (S59Y)
QVQLQESGGGLVQPGGSLRLSCEASPRTFSTYSMAWFRQAPGKERSFVAAINWSGGNTYYADSVKGRFTISRDNSKNTLYLQMNSLRAEDTAVYYCAAGGVLAHHNYEYDYWGQGTLVTVSS

SEQ ID NO: 58 - protein, 10 aa, Artificial Sequence
  Synthetic sdCDR1-Targeting sdAbs - alpha-B7H3 hF12 - (S59Y)
PRTFSTYSMA

SEQ ID NO: 59 - protein, 17 aa, Artificial Sequence
  Synthetic sdCDR2-Targeting sdAbs - alpha-B7H3 hF12 - (S59Y)
AINWSGGNTYYADSVKG

SEQ ID NO: 60 - protein, 13 aa, Artificial Sequence
  Synthetic sdCDR3-Targeting sdAbs - alpha-B7H3 hF12 - (S59Y)
GGVLAHHNYEYDY

SEQ ID NO: 61 - protein, 122 aa, Artificial Sequence
  Synthetic antigen binding domain -Targeting sdAbs - alpha-EpCAM h13
QVQLVESGGGLVQPGGSLTLSCAASGTGSIFSINLMGWYRQAPGKQRELVARITSGDSTVYADSVKGRFTISRDNSKNTLYLQMNSLRPEDTAVYYCNLLLRSSPGATTPYWGQGTLVTVSS

SEQ ID NO: 62 - protein, 12 aa, Artificial Sequence
  Synthetic sdCDR1 -Targeting sdAbs - alpha-EpCAM h13
GTGSIFSINLMG

SEQ ID NO: 63 - protein, 16 aa, Artificial Sequence
  Synthetic sdCDR2 -Targeting sdAbs - alpha-EpCAM h13
RITSGDSTVYADSVKG

SEQ ID NO: 64 - protein, 12 aa, Artificial Sequence
  Synthetic sdCDR3 -Targeting sdAbs - alpha-EpCAM h13
LLRSSPGATTPY

SEQ ID NO: 65 - protein, 122 aa, Artificial Sequence; identical to SEQ ID NO: 61
  Synthetic antigen binding domain -Targeting sdAbs - alpha-EpCAM h23

SEQ ID NO: 66 - protein, 10 aa, Artificial Sequence
  Synthetic sdCDR1 -Targeting sdAbs - alpha-EpCAM h23
GSFSALWAMR

SEQ ID NO: 67 - protein, 15 aa, Artificial Sequence
  Synthetic sdCDR2 -Targeting sdAbs - alpha-EpCAM h23
SSRGGTTSYADSVKG

SEQ ID NO: 68 - protein, 7 aa, Artificial Sequence
  Synthetic sdCDR3 -Targeting sdAbs - alpha-EpCAM h23
IDGHLAY

SEQ ID NO: 69 - protein, 126 aa, Artificial Sequence
  Synthetic antigen binding domain -Targeting sdAbs - acEpCAM hVIB665
QVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSS

SEQ ID NO: 70 - protein, 10 aa, Artificial Sequence
  Synthetic sdCDR1 -Targeting sdAbs - acEpCAM hVIB665
GRTFSDYDMG

SEQ ID NO: 71 - protein, 17 aa, Artificial Sequence
  Synthetic sdCDR2 -Targeting sdAbs - acEpCAM hVIB665
AISWSGGHTNYADSVKG

SEQ ID NO: 72 - protein, 17 aa, Artificial Sequence
  Synthetic sdCDR3 -Targeting sdAbs - acEpCAM hVIB665
DLRFTGGDTTTPETYDY

SEQ ID NO: 73 - protein, 126 aa, Artificial Sequence
  Synthetic antigen binding domain -Targeting sdAbs - acEpCAM hVIB666
QVQLVESGGGLVQPGRSLRLSCAASGRTLDNYDMGWFRQGPGKEREFVAAISWSGGSTDYAYSVTGRFTISRDNAKNSLYLQMNSLRAEDTALYYCAADLRFTGGDTMTPETYDYWGQGTLVTVSS

SEQ ID NO: 74 - protein, 10 aa, Artificial Sequence
  Synthetic sdCDR1-Targeting sdAbs - acEpCAM hVIB666
GRTLDNYDMG

SEQ ID NO: 75 - protein, 17 aa, Artificial Sequence
  Synthetic sdCDR2-Targeting sdAbs - acEpCAM hVIB666
AISWSGGSTDYAYSVTG

SEQ ID NO: 76 - protein, 17 aa, Artificial Sequence
  Synthetic sdCDR3-Targeting sdAbs - acEpCAM hVIB666
DLRFTGGDTMTPETYDY

SEQ ID NO: 77 - protein, 129 aa, Artificial Sequence
  Synthetic antigen binding domain -Targeting sdAbs - aTrop2 hVIB557
QVQLLESGGGLVQPGGSLRLSCAASGRTFSSQSMGWFRQAPGKEREFVSAISWTGANPTYADSVKGRFTISRDNSKNTLYLQMNSLRAEDTAVYYCAADTSGGSYYYERATAETSYDYWGQGTLVTVSS

SEQ ID NO: 78 - protein, 10 aa, Artificial Sequence
  Synthetic sdCDR1-Targeting sdAbs - aTrop2 hVIB557
GRTFSSQSMG

SEQ ID NO: 79 - protein, 17 aa, Artificial Sequence
  Synthetic sdCDR2-Targeting sdAbs - aTrop2 hVIB557
AISWTGANPTYADSVKG

SEQ ID NO: 80 - protein, 20 aa, Artificial Sequence
  Synthetic sdCDR3-Targeting sdAbs - aTrop2 hVIB557
DTSGGSYYYERATAETSYDY

SEQ ID NO: 81 - protein, 128 aa, Artificial Sequence
  Synthetic antigen binding domain -Targeting sdAbs - aTrop2 hVIB565
QVQLLESGGGLVQPGGSLRLSCAASGFTFDYYAIGWFRQAPGKEREGVSCISSSHGSTYYADSVKGRFTISRDNSKNTVYLQMNSLRAEDTAVYYCATAGDGGDYHCSGLVDYGMDYWGKGTLVTVSS

SEQ ID NO: 82 - protein, 10 aa, Artificial Sequence
  Synthetic sdCDR1-Targeting sdAbs - aTrop2 hVIB565
GFTFDYYAIG

SEQ ID NO: 83 - protein, 17 aa, Artificial Sequence
  Synthetic sdCDR2-Targeting sdAbs - aTrop2 hVIB565
CISSSHGSTYYADSVKG

SEQ ID NO: 84 - protein, 19 aa, Artificial Sequence
  Synthetic sdCDR3-Targeting sdAbs - aTrop2 hVIB565
AGDGGDYHCSGLVDYGMDY

SEQ ID NO: 85 - protein, 123 aa, Artificial Sequence
  Synthetic antigen binding domain -Targeting sdAbs - aTrop2 hVIB575
QVQLLESGGGLVQPGGSLRLSCLASGRTVGRTAMGWFRQPPGKEREFVATISWAGGTTYYADFVKGRFTISRDNSKNTLYLQMNSLRAEDTAVYYCAASEPYSDYDPSGMVYWGKGTLVTVSS

SEQ ID NO: 86 - protein, 10 aa, Artificial Sequence
  Synthetic sdCDR1-Targeting sdAbs - aTrop2 hVIB575
GRTVGRTAMG

SEQ ID NO: 87 - protein, 17 aa, Artificial Sequence
  Synthetic sdCDR2-Targeting sdAbs - aTrop2 hVIB575
TISWAGGTTYYADFVKG

SEQ ID NO: 88 - protein, 14 aa, Artificial Sequence
  Synthetic sdCDR3-Targeting sdAbs - aTrop2 hVIB575
SEPYSDYDPSGMVY

SEQ ID NO: 89 - protein, 123 aa, Artificial Sequence
  Synthetic antigen binding domain -Targeting sdAbs - aTrop2 hVIB578
QVQLLESGGGLVQPGGSLRLSCAASGRTFGRAAMGWFRQPPGKEREFAATISWSGSNTYYADFVKGRFTISRDNSKNTVYLQMNSLRAEDTAVYYCAASEPYSDYDPSGMVYWGKGTLVTVSS

SEQ ID NO: 90 - protein, 10 aa, Artificial Sequence
  Synthetic sdCDR1-Targeting sdAbs - aTrop2 hVIB578
GRTFGRAAMG

SEQ ID NO: 91 - protein, 17 aa, Artificial Sequence
  Synthetic sdCDR2-Targeting sdAbs - aTrop2 hVIB578
TISWSGSNTYYADFVKG

SEQ ID NO: 92 - protein, 14 aa, Artificial Sequence
  Synthetic sdCDR3-Targeting sdAbs - aTrop2 hVIB578
SEPYSDYDPSGMVY

SEQ ID NO: 93 - protein, 125 aa, Artificial Sequence
  Synthetic antigen binding domain -Targeting sdAbs - aTrop2 hVIB609
QVQLLESGGGLVQPGGSLRLSCALSGLTFNTYPMAWFRQPPGQEREFVADMSWSGTNTYYADSVKGRFTISRDNSKNTLYLQMNSLRAEDTAVYYCAAGWPYSGTGRSTTDYTYWGQGTLVTVSS

SEQ ID NO: 94 - protein, 10 aa, Artificial Sequence
  Synthetic sdCDR1-Targeting sdAbs - aTrop2 hVIB609
GLTFNTYPMA

SEQ ID NO: 95 - protein, 17 aa, Artificial Sequence
  Synthetic sdCDR2-Targeting sdAbs - aTrop2 hVIB609
DMSWSGTNTYYADSVKG

SEQ ID NO: 96 - protein, 16 aa, Artificial Sequence
  Synthetic sdCDR3-Targeting sdAbs - aTrop2 hVIB609
GWPYSGTGRSTTDYTY

SEQ ID NO: 97 - protein, 126 aa, Artificial Sequence
  Synthetic antigen binding domain -Targeting sdAbs - aTrop2 hVIB619
QVQLLESGGGLVQPGGSLRLSCAASGRSFSRYGMGWLRQAPGKERELVASISWSGHSTYYADSVKGRFTISRDNSKNTLYLQMNSLRAEDTAVYYCAAESLPYESGSPRLTDFASWGQGTLVTVSS

SEQ ID NO: 98 - protein, 10 aa, Artificial Sequence
  Synthetic sdCDR1-Targeting sdAbs - aTrop2 hVIB619
GRSFSRYGMG

SEQ ID NO: 99 - protein, 17 aa, Artificial Sequence
  Synthetic sdCDR2-Targeting sdAbs - aTrop2 hVIB619
SISWSGHSTYYADSVKG

SEQ ID NO: 100 - protein, 17 aa, Artificial Sequence
  Synthetic sdCDR3-Targeting sdAbs - aTrop2 hVIB619
ESLPYESGSPRLTDFAS

SEQ ID NO: 101 - protein, 119 aa, Artificial Sequence
  Synthetic antigen binding domain -Targeting sdAbs - aCA9 hVIB456 sdAb
QVQLVESGGGLVQPGGSLRLSCAASGSALIINAMGWYRQAPGKQRELVATVTRSGRTNYADSVKGRFTISRDNSKNTLYLQMNSLRAEDTAVYYCNVALWIADGEYDYWGQGTLVTVSS

SEQ ID NO: 102 - protein, 10 aa, Artificial Sequence
  Synthetic sdCDR1-Targeting sdAbs - aCA9 hVIB456 sdAb
GSALIINAMG

SEQ ID NO: 103 - protein, 16 aa, Artificial Sequence
  Synthetic sdCDR2-Targeting sdAbs - aCA9 hVIB456 sdAb
TVTRSGRTNYADSVKG

SEQ ID NO: 104 - protein, 11 aa, Artificial Sequence
  Synthetic sdCDR3-Targeting sdAbs - aCA9 hVIB456 sdAb
ALWIADGEYDY

SEQ ID NO: 105 - protein, 116 aa, Artificial Sequence
  Synthetic antigen binding domain -Targeting sdAbs - aCA9 hVIB476 sdAb
QVQLVESGGGLVQPGGSLRLSCAASGNIFIINVMGWYRQAPGKQRELVATITNGGRTHYADSVKGRFTISRDNSKNTLYLQMNSLRAEDTAVYYCNANHIELGDYWGQGTLVTVSS

SEQ ID NO: 106 - protein, 10 aa, Artificial Sequence
  Synthetic sdCDR1 -Targeting sdAbs - aCA9 hVIB476 sdAb
GNIFIINVMG

SEQ ID NO: 107 - protein, 16 aa, Artificial Sequence
  Synthetic sdCDR2 -Targeting sdAbs - aCA9 hVIB476 sdAb
TITNGGRTHYADSVKG

SEQ ID NO: 108 - protein, 8 aa, Artificial Sequence
  Synthetic sdCDR3 -Targeting sdAbs - aCA9 hVIB476 sdAb
NHIELGDY

SEQ ID NO: 109 - protein, 115 aa, Artificial Sequence
  Synthetic antigen binding domain -Targeting sdAbs - aCA9 hVIB407 sdAb
QVQLVESGGGLVQPGGSLRLSCTASGIIFSVYDMGWYRQTPGKQREFVARITAGGGTYLTDSVKGRFTISRDNSKNTLYLQMNSLRAEDTGVYYCNAAWIGDDYWGQGTLVTVSS

SEQ ID NO: 110 - protein, 10 aa, Artificial Sequence
  Synthetic sdCDR1-Targeting sdAbs - aCA9 hVIB407 sdAb
GIIFSVYDMG

SEQ ID NO: 111 - protein, 16 aa, Artificial Sequence
  Synthetic sdCDR2-Targeting sdAbs - aCA9 hVIB407 sdAb
RITAGGGTYLTDSVKG

SEQ ID NO: 112 - protein, 7 aa, Artificial Sequence
  Synthetic sdCDR3-Targeting sdAbs - aCA9 hVIB407 sdAb
AWIGDDY

SEQ ID NO: 113 - protein, 115 aa, Artificial Sequence
  Synthetic antigen binding domain -Targeting sdAbs - aCA9 hVIB445 sdAb
QVQLVESGGGLVKPGGSLRLSCAASGITFNLHAMRWYRRAPGKQRELVAYISARDWTNYADSVKGRFTISRDNAKNSLYLQMNSLRAEDTAVYYCNTDLVGEDYWGRGTLVTVSS

SEQ ID NO: 114 - protein, 10 aa, Artificial Sequence
  Synthetic sdCDR1 -Targeting sdAbs - aCA9 hVIB445 sdAb
GITFNLHAMR

SEQ ID NO: 115 - protein, 16 aa, Artificial Sequence
  Synthetic sdCDR2 -Targeting sdAbs - aCA9 hVIB445 sdAb
YISARDWTNYADSVKG

SEQ ID NO: 116 - protein, 7 aa, Artificial Sequence
  Synthetic sdCDR3 -Targeting sdAbs - aCA9 hVIB445 sdAb
DLVGEDY

SEQ ID NO: 117 - protein, 115 aa, Artificial Sequence
  Synthetic antigen binding domain -Targeting sdAbs - alpha-HSA half-life extension domain (aHSA (10GE))
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 118 - protein, 10 aa, Artificial Sequence
  Synthetic sdCDR1-Targeting sdAbs - alpha-HSA half-life extension domain (aHSA (10GE))
GFTFSKFGMS

SEQ ID NO: 119 - protein, 17 aa, Artificial Sequence
  Synthetic sdCDR2-Targeting sdAbs - alpha-HSA half-life extension domain (aHSA (10GE))
SISGSGRDTLYAESVKG

SEQ ID NO: 120 - protein, 6 aa, Artificial Sequence
  Synthetic sdCDR3-Targeting sdAbs - alpha-HSA half-life extension domain (aHSA (10GE))
GGSLSV

SEQ ID NO: 121 - protein, 121 aa, Artificial Sequence
  Synthetic antigen binding domain - alpha-HSA half life extension domain
EVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 122 - protein, 10 aa, Artificial Sequence
  Synthetic sdCDR1 - alpha-HSA half-life extension domain
GFTFSKFGMS

SEQ ID NO: 123 - protein, 17 aa, Artificial Sequence
  Synthetic sdCDR2 - alpha-HSA half-life extension domain
SISGSGRDTLYAESVKG

SEQ ID NO: 124 - protein, 6 aa, Artificial Sequence
  Synthetic sdCDR3 - alpha-HSA half-life extension domain
GGSLSV

SEQ ID NO: 125 - protein, 109 aa, Artificial Sequence
  Synthetic antigen binding domain - alpha-CD3 scFv Domain - alpha-CD3V(L)
QTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVL

SEQ ID NO: 126 - protein, 14 aa, Artificial Sequence
  Synthetic aVLCDR1 - alpha CD3 scFV Domain - alpha-CD3 V(L)
ASSTGAVTSGNYPN

SEQ ID NO: 127 - protein, 7 aa, Artificial Sequence
  Synthetic aVLsdCDR2 - alpha CD3 scFV Domain - alpha-CD3 V(L)
GTKFLVP

SEQ ID NO: 128 - protein, 9 aa, Artificial Sequence
  Synthetic aVLsdCDR3 - alpha CD3 scFV Domain - alpha-CD3 V(L)
TLWYSNRWV

SEQ ID NO: 129 - protein, 110 aa, Artificial Sequence
  Synthetic antigen binding domain - alpha-CD3 scFv Domain - alpha-CD3V(Li)
QTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVL

SEQ ID NO: 130 - protein, 14 aa, Artificial Sequence
  Synthetic iVLCDR1 - alpha CD3 scFV Domain - alpha-CD3 V(Li)
GSSTGAVTSGNYPN

SEQ ID NO: 131 - protein, 8 aa, Artificial Sequence
  Synthetic iVLsdCDR2 - alpha CD3 scFV Domain - alpha-CD3 V(Li)
DYKDDDDK

SEQ ID NO: 132 - protein, 9 aa, Artificial Sequence
  Synthetic iVLsdCDR3 - alpha CD3 scFV Domain - alpha-CD3 V(Li)
VLWYSNRWV

SEQ ID NO: 133 - protein, 109 aa, Artificial Sequence
  Synthetic antigen binding domain - alpha-CD3 scFv Domain - alpha-CD3V(Li2)
QTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVL

SEQ ID NO: 134 - protein, 14 aa, Artificial Sequence
  Synthetic iVLCDR1 - alpha CD3 scFV Domain - alpha-CD3 V(Li2)
GSSTGAVTSGNYPN

SEQ ID NO: 135 - protein, 7 aa, Artificial Sequence
  Synthetic iVLCDR2 - alpha CD3 scFV Domain - alpha-CD3 V(Li2)
GTKDDAP

SEQ ID NO: 136 - protein, 9 aa, Artificial Sequence
  Synthetic iVLCDR3 - alpha CD3 scFV Domain - alpha-CD3 V(Li2)
VLWYSNRWV

SEQ ID NO: 137 - protein, 109 aa, Artificial Sequence
  Synthetic antigen binding domain - alpha-CD3 scFv Domain - alpha- CD3 VliGL
QTVVTQEPSLTVSPGGTVTLTCGSSTGAVTSGHYPNWVQQKPGQAPRGLIGGTSNKHSWTPARFSGSLLGGKAALTLSGVQPEDEAEYYCVLWGSRRWVFGGGTKLTVL

SEQ ID NO: 138 - protein, 14 aa, Artificial Sequence
  Synthetic aVLiGLCDR1 - alpha-CD3 scFv Domain - alpha- CD3 VliGL
GSSTGAVTSGHYPN

SEQ ID NO: 139 - protein, 7 aa, Artificial Sequence
  Synthetic aVLiGLCDR2 - alpha-CD3 scFv Domain - alpha- CD3 VliGL
GTSNKHS

SEQ ID NO: 140 - protein, 9 aa, Artificial Sequence
  Synthetic aVLiGLCDR3 - alpha-CD3 scFv Domain - alpha- CD3 VliGL
VLWGSRRWV

SEQ ID NO: 141 - protein, 125 aa, Artificial Sequence
  Synthetic antigen binding domain - alpha-CD3 scFv Domain - alpha-CD3V(H)
EVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSS

SEQ ID NO: 142 - protein, 10 aa, Artificial Sequence
  Synthetic aVHCDR1 - alpha CD3 scFV Domain - alpha-CD3 V(H)
GFTFNKYAIN

SEQ ID NO: 143 - protein, 19 aa, Artificial Sequence
  Synthetic aVHsdCDR2 - alpha CD3 scFV Domain - alpha-CD3 V(H)
RIRSKYNNYATYYADQVKD

SEQ ID NO: 144 - protein, 14 aa, Artificial Sequence
  Synthetic aVHsdCDR3 - alpha CD3 scFV Domain - alpha-CD3 V(H)
HANFGNSYISYWAY

SEQ ID NO: 145 - protein, 126 aa, Artificial Sequence
  Synthetic antigen binding domain - alpha-CD3 scFv Domain - alpha-CD3V(Hi)
EVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSS

SEQ ID NO: 146 - protein, 10 aa, Artificial Sequence
  Synthetic iVHsdCDR1 - alpha CD3 scFV Domain - alpha-CD3 V(Hi)
GFTFNKYAMN

SEQ ID NO: 147 - protein, 20 aa, Artificial Sequence
  Synthetic iVHsdCDR2 - alpha CD3 scFV Domain - alpha-CD3 V(Hi)
RIRSKYDYKDDDDKADSVKD

SEQ ID NO: 148 - protein, 14 aa, Artificial Sequence
  Synthetic iVHsdCDR3 - alpha CD3 scFV Domain - alpha-CD3 V(Hi)
HGNFGNSYISYWAY

SEQ ID NO: 149 - protein, 125 aa, Artificial Sequence
  Synthetic antigen binding domain - alpha-CD3 scFv Domain - alpha-CD3V(Hi2)
EVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSS

SEQ ID NO: 150 - protein, 10 aa, Artificial Sequence
  Synthetic iVHsdCDR1 - alpha CD3 scFV Domain - alpha-CD3 V(Hi2)
GFTFNKHAMN

SEQ ID NO: 151 - protein, 19 aa, Artificial Sequence
  Synthetic iVHsdCDR2 - alpha CD3 scFV Domain - alpha-CD3 V(Hi2)
RIRSKYNNYATAYADSVKD

SEQ ID NO: 152 - protein, 14 aa, Artificial Sequence
  Synthetic iVHsdCDR3 - alpha CD3 scFV Domain - alpha-CD3 V(Hi2)
HGNFGNSYISYWAY

SEQ ID NO: 153 - protein, 125 aa, Artificial Sequence
  Synthetic antigen binding domain - alpha-CD3 scFv Domain - alpha - CD3 VHiGL4
EVQLVESGGGLVQPGGSLKLSCAASGFTFSGYAMNWVRQAPGKGLEWVARIRSKANSYATEYAASVKDRFTISRDDSKNTAYLQMNNLKTEDTAVYYCVRHGNAGNSAISYWAYWGQGTLVTVSS

SEQ ID NO: 154 - protein, 10 aa, Artificial Sequence
  Synthetic aVHiGL4CDR1 - alpha-CD3 scFv Domain - alpha - CD3 VHiGL4
GFTFSGYAMN

SEQ ID NO: 155 - protein, 19 aa, Artificial Sequence
  Synthetic aVHiGL4CDR2 - alpha-CD3 scFv Domain - alpha - CD3 VHiGL4
RIRSKANSYATEYAASVKD

SEQ ID NO: 156 - protein, 14 aa, Artificial Sequence
  Synthetic aVHiGL4CDR3 - alpha-CD3 scFv Domain - alpha - CD3 VHiGL4
HGNAGNSAISYWAY

SEQ ID NO: 157 - protein, 8 aa, Artificial Sequence
  Synthetic cleavable linker - MMP 2/9
GPAGMKGL

SEQ ID NO: 158 - protein, 15 aa, Artificial Sequence
  Synthetic cleavable linker - MMP 2/9
SGGPGPAGMKGLPGS

SEQ ID NO: 159 - protein, 17 aa, Artificial Sequence
  Synthetic cleavable linker - MMP 2/9
SGGGPGPAGMKGLPGGS

SEQ ID NO: 160 - protein, 16 aa, Artificial Sequence
  Synthetic cleavable linker - Meprin A/B
GGGGKKLADEPEGGGS

SEQ ID NO: 161 - protein, 15 aa, Artificial Sequence
  Synthetic cleavable linker - Meprin A/B
SGGGKKLADEPEGGS

SEQ ID NO: 162 - protein, 8 aa, Artificial Sequence
  Synthetic cleavable linker - Meprin A/B
KKLADEPE

SEQ ID NO: 163 - protein, 13 aa, Artificial Sequence
  Synthetic cleavable linker - Meprin A/B (Variant, high efficiency)
GGGKFLADEPEGG

SEQ ID NO: 164 - protein, 16 aa, Artificial Sequence
  Synthetic cleavable linker - Cathepsin S,K,L
SGGGARLQSAAPGGGS

SEQ ID NO: 165 - protein, 16 aa, Artificial Sequence
  Synthetic cleavable linker - Cathepsin S,K,L
SGGGARLQSAAPGGGS

SEQ ID NO: 166 - protein, 8 aa, Artificial Sequence
  Synthetic cleavable linker - Cathepsin S,K,L
ARLQSAAP

SEQ ID NO: 167 - protein, 18 aa, Artificial Sequence
  Synthetic cleavable linker - Meprin/Granzyme B
SGGGGVYADSLEDGGGGS

SEQ ID NO: 168 - protein, 10 aa, Artificial Sequence
  Synthetic cleavable linker - Meprin/Granzyme B
GVYADSLEDG

SEQ ID NO: 169 - protein, 16 aa, Artificial Sequence
  Synthetic cleavable linker - Matriptase/uPA (MS)
GGGSLSGRSDNHGGGS

SEQ ID NO: 170 - protein, 10 aa, Artificial Sequence
  Synthetic cleavable linker - Matriptase/uPA (MS)
GLSGRSDNHG

SEQ ID NO: 171 - protein, 17 aa, Artificial Sequence
  Synthetic cleavable linker - Matriptase (MV)
SGGGSFTRQARVVGGGS

SEQ ID NO: 172 - protein, 9 aa, Artificial Sequence
  Synthetic cleavable linker - Matriptase (MV)
SFTRQARVV

SEQ ID NO: 173 - protein, 14 aa, Artificial Sequence
  Synthetic cleavable linker - CathepsinS/MMP9/Meprin A
ARLQSAAPAGLKGA

SEQ ID NO: 174 - protein, 16 aa, Artificial Sequence
  Synthetic cleavable linker - CathepsinS/MMP9/Meprin A
GARLQSAAPAGLKGAG

SEQ ID NO: 175 - protein, 13 aa, Artificial Sequence
  Synthetic cleavable linker - MMP9 (Variant, high efficiency)
GGPGPAGMHGLPG

SEQ ID NO: 176 - protein, 17 aa, Artificial Sequence
  Synthetic cleavable linker - MMP9 (Variant, high efficiency)
GSGGPGPAGMHGLPGGS

SEQ ID NO: 177 - protein, 13 aa, Artificial Sequence
  Synthetic cleavable linker - MMP9 (Variant, low efficiency)
GGPGPAGMEGLPG

SEQ ID NO: 178 - protein, 15 aa, Artificial Sequence
  Synthetic cleavable linker - MMP9-15 (K>E)
SGGPGPAGMEGLPGS

SEQ ID NO: 179 - protein, 15 aa, Artificial Sequence
  Synthetic cleavable linker - MMP9-15 (M>P)
SGGPGPAGPKGLPGS

SEQ ID NO: 180 - protein, 16 aa, Artificial Sequence
  Synthetic cleavable linker - Thrombin 1
GGGGLVPRGSLGGGGS

SEQ ID NO: 181 - protein, 15 aa, Artificial Sequence
  Synthetic cleavable linker - Thrombin 2
SSGGGMPRSFRGGGS

SEQ ID NO: 182 - protein, 16 aa, Artificial Sequence
  Synthetic cleavable linker - Enterokinase/Flag
GGGGDYKDDDDKGGGS

SEQ ID NO: 183 - protein, 16 aa, Artificial Sequence
  Synthetic cleavable linker - KLK7-6
SGGGQNPYSAGRGGGS

SEQ ID NO: 184 - protein, 16 aa, Artificial Sequence
  Synthetic cleavable linker - KLK7-13
SGGGQNPYSAGGGSGG

SEQ ID NO: 185 - protein, 16 aa, Artificial Sequence
  Synthetic cleavable linker - KLK7-11
SGGGRNVYSAGGGSGG

SEQ ID NO: 186 - protein, 16 aa, Artificial Sequence
  Synthetic cleavable linker - KLK7-10
SGGGQNTWSAGKGGGS

SEQ ID NO: 187 - protein, 16 aa, Artificial Sequence
  Synthetic cleavable linker - uPA
GGGSHTGRSAYFGGGS

SEQ ID NO: 188 - protein, 15 aa, Artificial Sequence
  Synthetic cleavable linker - MMP9-2
SGGPGPAGLKGAPGS

SEQ ID NO: 189 - protein, 8 aa, Artificial Sequence
  Synthetic protease cleavage site - MMP7
KRALGLPG

SEQ ID NO: 190 - protein, 24 aa, Artificial Sequence
  Synthetic protease cleavage site - MMP7
  MISC_FEATURE (1)..(8): X can be Asp or Glu
  MISC_FEATURE (17)..(24): X can be Asp or Arg
XXXXXXXXRPLALWRSXXXXXXXX

SEQ ID NO: 191 - protein, 8 aa, Artificial Sequence
  Synthetic protease cleavage site - MMP9
PRSTLIST

SEQ ID NO: 192 - protein, 5 aa, Artificial Sequence
  Synthetic protease cleavage site - MMP9
LEATA

SEQ ID NO: 193 - protein, 10 aa, Artificial Sequence
  Synthetic protease cleavage site - MMP11
GGAANLVRGG

SEQ ID NO: 194 - protein, 10 aa, Artificial Sequence
  Synthetic protease cleavage site - MMP14
SGRIGFLRTA

SEQ ID NO: 195 - protein, 6 aa, Artificial Sequence
  Synthetic protease cleavage site - MMP
PLGLAG

SEQ ID NO: 196 - protein, 6 aa, Artificial Sequence
  Synthetic protease cleavage site - MMP
  misc_feature (6)..(6): Xaa can be any naturally occurring amino acid
PLGLAX

SEQ ID NO: 197 - protein, 7 aa, Artificial Sequence
  Synthetic protease cleavage site - MMP
  MISC_FEATURE (5)..(5): X can be Met or Glu
PLGCXAG

SEQ ID NO: 198 - protein, 8 aa, Artificial Sequence
  Synthetic protease cleavage site - MMP
ESPAYYTA

SEQ ID NO: 199 - protein, 6 aa, Artificial Sequence
  Synthetic protease cleavage site - MMP
RLQLKL

SEQ ID NO: 200 - protein, 7 aa, Artificial Sequence
  Synthetic protease cleavage site - MMP
RLQLKAC

SEQ ID NO: 201 - protein, 7 aa, Artificial Sequence
  Synthetic protease cleavage site - MMP2, MMP9, MMP14
  MISC_FEATURE (3)..(3): X can be Cys or Ile or Thr
  MISC_FEATURE (5)..(5): X can be His or Orn or Phe
EPXGXYL

SEQ ID NO: 202 - protein, 5 aa, Artificial Sequence
  Synthetic protease cleavage site - Urokinase plasminogen activator (upa)
SGRSA

SEQ ID NO: 203 - protein, 4 aa, Artificial Sequence
  Synthetic protease cleavage site - Urokinase plasminogen activator (upa)
DAFK

SEQ ID NO: 204 - protein, 5 aa, Artificial Sequence
  Synthetic protease cleavage site - Urokinase plasminogen activator (upa)
GGGRR

SEQ ID NO: 205 - protein, 4 aa, Artificial Sequence
  Synthetic protease cleavage site - Lysosomal enzyme
GFLG

SEQ ID NO: 206 - protein, 4 aa, Artificial Sequence
  Synthetic protease cleavage site - Lysosomal enzyme
ALAL

SEQ ID NO: 207 - protein, 2 aa, Artificial Sequence
  Synthetic protease cleavage site - Lysosomal enzyme
FK

SEQ ID NO: 208 - protein, 3 aa, Artificial Sequence
  Synthetic protease cleavage site - Cathepsin B
NLL

SEQ ID NO: 209 - protein, 6 aa, Artificial Sequence
  Synthetic protease cleavage site - Cathepsin D
  MISC_FEATURE (4)..(4)
PICXFF

SEQ ID NO: 210 - protein, 8 aa, Artificial Sequence
  Synthetic protease cleavage site - Cathepsin K
GGPRGLPG

SEQ ID NO: 211 - protein, 6 aa, Artificial Sequence
  Synthetic protease cleavage site - Prostate specific antigen
HSSKLQ

SEQ ID NO: 212 - protein, 7 aa, Artificial Sequence
  Synthetic protease cleavage site - Prostate specific antigen
HSSKLQL

SEQ ID NO: 213 - protein, 9 aa, Artificial Sequence
  Synthetic protease cleavage site - Prostate specific antigen
HSSKLQEDA

SEQ ID NO: 214 - protein, 10 aa, Artificial Sequence
  Synthetic protease cleavage site - Herpes simplex virus protease
LVLASSSFGY

SEQ ID NO: 215 - protein, 10 aa, Artificial Sequence
  Synthetic protease cleavage site - Hiv protease
GVSQNYPIVG

SEQ ID NO: 216 - protein, 10 aa, Artificial Sequence
  Synthetic protease cleavage site - Cmv protease
GVVQASCRLA

SEQ ID NO: 217 - protein, 4 aa, Artificial Sequence
  Synthetic protease cleavage site - Thrombin
  misc_feature (2)..(2): Xaa can be any naturally occurring amino acid
FXRS

SEQ ID NO: 218 - protein, 6 aa, Artificial Sequence
  Synthetic protease cleavage site - Thrombin
DPRSFL

SEQ ID NO: 219 - protein, 6 aa, Artificial Sequence
  Synthetic protease cleavage site - Thrombin
PPRSFL

SEQ ID NO: 220 - protein, 4 aa, Artificial Sequence
  Synthetic protease cleavage site - Caspase-3
DEVD

SEQ ID NO: 221 - protein, 5 aa, Artificial Sequence
  Synthetic protease cleavage site - Caspase-3
DEVDP

SEQ ID NO: 222 - protein, 8 aa, Artificial Sequence
  Synthetic protease cleavage site - Caspase-3
KGSGDVEG

SEQ ID NO: 223 - protein, 6 aa, Artificial Sequence
  Synthetic protease cleavage site - Interleukin 1-beta converting enzyme
GWEHDG

SEQ ID NO: 224 - protein, 7 aa, Artificial Sequence
  Synthetic protease cleavage site - Enterokinase
EDDDDKA

SEQ ID NO: 225 - protein, 9 aa, Artificial Sequence
  Synthetic protease cleavage site - Fap
KQEQNPGST

SEQ ID NO: 226 - protein, 6 aa, Artificial Sequence
  Synthetic protease cleavage site - Kallikrein 2
GKAFRR

SEQ ID NO: 227 - protein, 4 aa, Artificial Sequence
  Synthetic protease cleavage site - Plasmin
DAFK

SEQ ID NO: 228 - protein, 4 aa, Artificial Sequence
  Synthetic protease cleavage site - Plasmin
DVLK

SEQ ID NO: 229 - protein, 4 aa, Artificial Sequence
  Synthetic protease cleavage site - Plasmin
DAFK

SEQ ID NO: 230 - protein, 7 aa, Artificial Sequence
  Synthetic protease cleavage site - Top
ALLLALL

SEQ ID NO: 231 - protein, 889 aa, Artificial Sequence
  Synthetic construct - Pro140 Format 1
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGPAGMKGLQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 232 - protein, 890 aa, Artificial Sequence
  Synthetic construct - Pro140b Format 1
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSKKLADEPEQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSKKLADEPEGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 233 - protein, 889 aa, Artificial Sequence
  Synthetic construct - Pro186 Format 2
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 234 - protein, 890 aa, Artificial Sequence
  Synthetic construct - Pro187 Format 2
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSKKLADEPEGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSS

SEQ ID NO: 235 - protein, 895 aa, Artificial Sequence
  Synthetic construct - Pro225 (FL aB7H3 hF7 MMP9 linker) Format 2
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 236 - protein, 891 aa, Artificial Sequence
  Synthetic construct - Pro226 (FL aB7H3 hF12 MMP9 linker) Format 2
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 237 - protein, 895 aa, Artificial Sequence
  Synthetic construct - Pro233 (humanized Pro186) Format 2
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 238 - protein, 875 aa, Artificial Sequence
  Synthetic construct - Pro311 (FL aFOLR1 h77.2 MMP9 linker) Format 2
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 239 - protein, 873 aa, Artificial Sequence
  Synthetic construct - Pro312 (FL aFOLR1 h59.3 MMP9 linker)
QVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 240 - protein, 761 aa, Artificial Sequence
  Synthetic construct - Pro313 (FL aFOLR1 h22.4 MMP9 linker) Format 2
SGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCEASGTTFSRDVMGWYRQAPGKQRELVAIISRGGSTNYADSVKGRFTISRDNSKNTLYLQMNSLRAEDTAVYYCNANTATWGRVFWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 241 - protein, 898 aa, Artificial Sequence
  Synthetic construct - Pro246 (FL haEGFR1/haEGFR2 heterologous COBRA with MMP9 linker)
EVQLVESGGGLVQPGGSLRLSCAASGRTFSSYAMGWFRQAPGKEREFVVAINWSSGSTYYADSVKGRFTISRDNSKNTLYLQMNSLRAEDTAVYYCAAGYQINSGNYNFKDYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 242 - protein, 893 aa, Artificial Sequence
  Synthetic construct - Pro256 (FL haEpCAM VIB13/haEGFR1 heterologous COBRA MMP9 linker)
QVQLVESGGGLVQPGGSLTLSCAASGTGSIFSINLMGWYRQAPGKQRELVARITSGDSTVYADSVKGRFTISRDNSKNTLYLQMNSLRPEDTAVYYCNLLLRSSPGATTPYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 243 - protein, 885 aa, Artificial Sequence
  Synthetic construct - Pro420 (FL aFOLR1 h77.2/haEGFR1 heterologous COBRA MMP9 linker)
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 244 - protein, 885 aa, Artificial Sequence
  Synthetic construct - Pro421 (FL haEGFR1/aFOLR1 h77.2 heterologous COBRA MMP9 linker)
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 245 - protein, 896 aa, Artificial Sequence
  Synthetic construct - Pro393 (Pro186 S9 linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGARLQSAAPAGLKGAGQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 246 - protein, 896 aa, Artificial Sequence
  Synthetic construct - Pro394 (Pro186 ST14(MV) linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSFTRQARVVGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 247 - protein, 896 aa, Artificial Sequence
  Synthetic construct - Pro395 (Pro186 CathS linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSARLQSAAPGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 248 - protein, 897 aa, Artificial Sequence
  Synthetic construct - Pro396 (Pro186 MMP9v linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 249 - protein, 896 aa, Artificial Sequence
  Synthetic construct - Pro429 (Pro186 Meprin/GranzymeB linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGGVYADSLEDGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 250 - protein, 895 aa, Artificial Sequence
  Synthetic construct - Pro430 (Pro186 MMP9-2 linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGLKGAPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 251 - protein, 896 aa, Artificial Sequence
  Synthetic construct - Pro431 (Pro186 ST14(MS) linker)
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSLSGRSDNHGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 252 - protein, 763 aa, Artificial Sequence
  Synthetic construct - Pro258 (Pro186 with a single aEGFR domain and a central aHSA domain)
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSHHHHHH

SEQ ID NO: 253 - protein, 896 aa, Artificial Sequence
  Synthetic construct - Pro221 - Cleavable linker variant
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGGQNPYSAGRGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 254 - protein, 896 aa, Artificial Sequence
  Synthetic construct - Pro222 - Cleavable linker variant
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGGQNPYSAGGGSGGQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 255 - protein, 896 aa, Artificial Sequence
  Synthetic construct - Pro223 - Cleavable linker variant
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGGRNVYSAGGGSGGQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 256 - protein, 896 aa, Artificial Sequence
  Synthetic construct - Pro224- Cleavable linker variant
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGGQNTWSAGKGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 257 - protein, 898 aa, Artificial Sequence
  Synthetic construct - Pro254- Heterologous Format 2
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSEVQLVESGGGLVQPGGSLRLSCAASGRTFSSYAMGWFRQAPGKEREFVVAINWSSGSTYYADSVKGRFTISRDNSKNTLYLQMNSLRAEDTAVYYCAAGYQINSGNYNFKDYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 258 - protein, 893 aa, Artificial Sequence
  Synthetic construct - Pro255- Heterologous Format 2
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLTLSCAASGTGSIFSINLMGWYRQAPGKQRELVARITSGDSTVYADSVKGRFTISRDNSKNTLYLQMNSLRPEDTAVYYCNLLLRSSPGATTPYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 259 - protein, 902 aa, Artificial Sequence
  Synthetic construct - Pro262
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 260 - protein, 766 aa, Artificial Sequence
  Synthetic construct - Pro356 - Format 4
EVQLVESGGGLVQPGGSLRLSCAASGRTFSSYAMGWFRQAPGKEREFVVAINWSSGSTYYADSVKGRFTISRDNSKNTLYLQMNSLRAEDTAVYYCAAGYQINSGNYNFKDYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSHHHHHH

SEQ ID NO: 261 - protein, 763 aa, Artificial Sequence
  Synthetic construct - Pro359 - Format 4
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSHHHHHH

SEQ ID NO: 262 - protein, 752 aa, Artificial Sequence
  Synthetic construct - Pro364 - Format 4
QVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSHHHHHH

SEQ ID NO: 263 - protein, 753 aa, Artificial Sequence
  Synthetic construct - Pro388 - Format 4
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSGGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSHHHHHH

SEQ ID NO: 264 - protein, 896 aa, Artificial Sequence; identical to SEQ ID NO: 249
  Synthetic construct - Pro429 - Format 4

SEQ ID NO: 265 - protein, 895 aa, Artificial Sequence; identical to SEQ ID NO: 250
  Synthetic construct - Pro430 - Format 4

SEQ ID NO: 266 - protein, 896 aa, Artificial Sequence; identical to SEQ ID NO: 251
  Synthetic construct - Pro431 - Format 4

SEQ ID NO: 267 - protein, 896 aa, Artificial Sequence
  Synthetic construct - Pro432- Heterologous - Format 2
QVQLVESGGGLVQPGGSLTLSCAASGTGSIFSINLMGWYRQAPGKQRELVARITSGDSTVYADSVKGRFTISRDNSKNTLYLQMNSLRPEDTAVYYCNLLLRSSPGATTPYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSEVQLVESGGGLVQPGGSLRLSCAASGRTFSSYAMGWFRQAPGKEREFVVAINWSSGSTYYADSVKGRFTISRDNSKNTLYLQMNSLRAEDTAVYYCAAGYQINSGNYNFKDYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 268 - protein, 636 aa, Artificial Sequence
  Synthetic construct - Pro448- Dual Targeting Hemis Format 3
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 269 - protein, 636 aa, Artificial Sequence
  Synthetic construct - Pro449 Dual Targeting Hemis Format 3
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGGSGGGSQVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 270 - protein, 636 aa, Artificial Sequence
  Synthetic construct - Pro450 Dual Targeting Hemis Format 3
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 271 - protein, 636 aa, Artificial Sequence
  Synthetic construct - Pro451 Dual Targeting Hemis Format 3
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGGSGGGSQVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLSGGPGPAGMKGLPGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 272 - protein, 893 aa, Artificial Sequence
  Synthetic construct - Pro479- Heterologous - Format 2
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 273 - protein, 893 aa, Artificial Sequence
  Synthetic construct - Pro480- Heterologous - Format 2
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 274 - protein, 893 aa, Artificial Sequence
  Synthetic construct - Pro495 - Format 2
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 275 - protein, 893 aa, Artificial Sequence; identical to SEQ ID NO: 274
  Synthetic construct - Pro601 aB7H3 hF7 sdAb - aCD3 Vh (2B2) - NCL-8 - aCD3Vl (2B2) - aB7H3 hF7 sdAb - MMP9-15 - aCD3Vli2 -NCL-8 - aCD3Vhi2 - aHSA (10GE) - His6

SEQ ID NO: 276 - protein, 889 aa, Artificial Sequence
  Synthetic construct - Pro602 aB7H3 hF12 sdAb - aCD3 Vh (2B2) - NCL-8 - aCD3Vl (2B2) - aB7H3 hF12 sdAb - MMP9-15 - aCD3Vli2 -NCL-8 - aCD3Vhi2 - aHSA (10GE) - His6
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 277 - protein, 891 aa, Artificial Sequence
  Synthetic construct - V3 - aB7H3 hF7 sdAb - aCD3 Vh (2B2) - NCL-8 - aCD3Vl (2B2) - aB7H3 hF12 sdAb - MMP9-15 - aCD3Vli2 -NCL-8 - aCD3Vhi2 - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 278 - protein, 891 aa, Artificial Sequence
  Synthetic construct - V4 - aB7H3 hF12 sdAb - aCD3 Vh (2B2) - NCL-8 - aCD3Vl (2B2) - aB7H3 hF7 sdAb - MMP9-15 - aCD3Vli2 -NCL-8 - aCD3Vhi2 - aHSA (10GE) - His6
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 279 - protein, 891 aa, Artificial Sequence
  Synthetic construct - Pro664 - aB7H3 hF12 (S59Y) sdAb - aCD3 Vh (2B2) - NCL-8 - aCD3Vl (2B2) - aB7H3 hF12 sdAb - MMP9-15 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGNTYYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTYYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 280 - protein, 891 aa, Artificial Sequence
  Synthetic construct - Pro665 - aB7H3 hF12 (N57Q) sdAb - aCD3 Vh (2B2) - NCL-8 - aCD3Vl (2B2) - aB7H3 hF12 sdAb - MMP9-15 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGQTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGQTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 281 - protein, 891 aa, Artificial Sequence
  Synthetic construct - Pro667 - aB7H3 hF12 (N57E) sdAb - aCD3 Vh (2B2) - NCL-8 - aCD3Vl (2B2) - aB7H3 hF12 sdAb - MMP9-15 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGETSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGETSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 282 - protein, 891 aa, Artificial Sequence
  Synthetic construct - Pro694 - aB7H3 hF12 (S59A) sdAb - aCD3 Vh (2B2) - NCL-8 - aCD3Vl (2B2) - aB7H3 hF12 sdAb - MMP9-15 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGNTAYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTAYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 283 - protein, 891 aa, Artificial Sequence
  Synthetic construct - Pro695 - aB7H3 hF12 (N57D) sdAb - aCD3 Vh (2B2) - NCL-8 - aCD3Vl (2B2) - aB7H3 hF12 sdAb - MMP9-15 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGDTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGDTSYADSVKGRFTISRDNSKNTLYLQMNSLRAEDTAVYYCAAGGVLAHHNYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 284 - protein, 891 aa, Artificial Sequence
  Synthetic construct - Pro766 - aB7H3 hF12 sdAb - aCD3 Vh (2B2) - NCL-8 - aCD3Vl (2B2) - aB7H3 hF12 sdAb - NCL-15 - aCD3Vli -NCL-8 - aCD3Vhi - aHSA (10GE) - His6
QVQLQESGGGLVQPGGSLRLSCEASPRTFSTYSMAWFRQAPGKERSFVAAINWSGGNTYYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTYYADSVKGRFTISRDNSKNTLYLQMNSLRAEDTAVYYCAAGGVLAHHNYEYDYWGQGTLVTVSSGGGGSGGGGSGGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 285 - protein, 899 aa, Artificial Sequence
  Synthetic construct - Pro565 acEpCAM hVIB664 sdAb - aCD3 Vh (2B2) - NCL-8 - aCD3Vl (2B2) - acEpCAM hVIB664 sdAb - - MMP9-15 - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 286 - protein, 899 aa, Artificial Sequence
  Synthetic construct - Pro566 - acEpCAM hVIB665 sdAb - aCD3 Vh (2B2) - NCL-8 - aCD3Vl (2B2) - acEpCAM hVIB665 sdAb - MMP9-15 - aCD3Vli - NCL-8 - aCD3Vhi - aHSA (10GE) - His6
QVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 287 - protein, 899 aa, Artificial Sequence
  Synthetic construct - Pro567- acEpCAM hVIB666 sdAb - aCD3 Vh (2B2) - NCL-8 - aCD3Vl (2B2) - acEpCAM hVIB666 sdAb - MMP9-15 - aCD3Vli - NCL-8 - aCD3Vhi - aHSA (10GE) - His6
QVQLVESGGGLVQPGRSLRLSCAASGRTLDNYDMGWFRQGPGKEREFVAAISWSGGSTDYAYSVTGRFTISRDNAKNSLYLQMNSLRAEDTALYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGRSLRLSCAASGRTLDNYDMGWFRQGPGKEREFVAAISWSGGSTDYAYSVTGRFTISRDNAKNSLYLQMNSLRAEDTALYYCAADLRFTGGDTMTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 288 - protein, 899 aa, Artificial Sequence
  Synthetic construct - Pro568 - acEpCAM hVIB664 sdAb - aCD3 Vh (2B2) - NCL-8 - aCD3Vl (2B2) - acEpCAM hVIB664 sdAb - NCL-16 - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGGSGGGGSGGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 289 - protein, 899 aa, Artificial Sequence
  Synthetic construct - Pro727 - acEpCAM hVIB664 sdAb - aCD3 Vh (2B2) - NCL-8 - aCD3Vl (2B2) - acEpCAM hVIB664 sdAb - Meprin-15 - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSSGGGKKLADEPEGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 290 - protein, 901 aa, Artificial Sequence
  Synthetic construct - Pro728 - acEpCAM hVIB664 sdAb - aCD3 Vh (2B2) - NCL-8 - aCD3Vl (2B2) - acEpCAM hVIB664 sdAb - MMP9v - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 291 - protein, 900 aa, Artificial Sequence
  Synthetic construct - Pro729  - acEpCAM hVIB664 sdAb - aCD3 Vh (2B2) - NCL-8 - aCD3Vl (2B2) - acEpCAM hVIB664 sdAb - CathS - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSARLQSAAPGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 292 - protein, 900 aa, Artificial Sequence
  Synthetic construct - Pro730 - acEpCAM hVIB664 sdAb - aCD3 Vh (2B2) - NCL-8 - aCD3Vl (2B2) - acEpCAM hVIB664 sdAb - S9 - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGARLQSAAPAGLKGAGQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 293 - protein, 900 aa, Artificial Sequence
  Synthetic construct - Pro731 - acEpCAM hVIB664 sdAb - aCD3 Vh (2B2) - NCL-8 - aCD3Vl (2B2) - acEpCAM hVIB664 sdAb - ST14-MS - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSLSGRSDNHGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 294 - protein, 903 aa, Artificial Sequence
  Synthetic construct - Pro676 - aTrop2 hVIB565 sdAb - aCD3 Vh (2B2) - NCL-8 - aCD3Vl (2B2) - aTrop2 hVIB565 sdAb - MMP9-15 - aCD3Vli - NCL-8 - aCD3Vhi - aHSA (10GE) - His6
QVQLLESGGGLVQPGGSLRLSCAASGFTFDYYAIGWFRQAPGKEREGVSCISSSHGSTYYADSVKGRFTISRDNSKNTVYLQMNSLRAEDTAVYYCATAGDGGDYHCSGLVDYGMDYWGKGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGFTFDYYAIGWFRQAPGKEREGVSCISSSHGSTYYADSVKGRFTISRDNSKNTVYLQMNSLRAEDTAVYYCATAGDGGDYHCSGLVDYGMDYWGKGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 295 - protein, 905 aa, Artificial Sequence
  Synthetic construct - Pro677 - aTrop2 hVIB557 sdAb sdAb - aCD3 Vh (2B2) - NCL-8 - aCD3Vl (2B2) - aTrop2 hVIB557 sdAb sdAb - MMP9-15 - aCD3Vli - NCL-8 - aCD3Vhi - aHSA (10GE) - His6
QVQLLESGGGLVQPGGSLRLSCAASGRTFSSQSMGWFRQAPGKEREFVSAISWTGANPTYADSVKGRFTISRDNSKNTLYLQMNSLRAEDTAVYYCAADTSGGSYYYERATAETSYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFSSQSMGWFRQAPGKEREFVSAISWTGANPTYADSVKGRFTISRDNSKNTLYLQMNSLRAEDTAVYYCAADTSGGSYYYERATAETSYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 296 - protein, 893 aa, Artificial Sequence
  Synthetic construct - Pro678 - aTrop2 hVIB575 sdAb - aCD3 Vh (2B2) - NCL-8 - aCD3Vl (2B2) - aTrop2 hVIB575 sdAb - MMP9-15 - aCD3Vli - NCL-8 - aCD3Vhi - aHSA (10GE) - His6
QVQLLESGGGLVQPGGSLRLSCLASGRTVGRTAMGWFRQPPGKEREFVATISWAGGTTYYADFVKGRFTISRDNSKNTLYLQMNSLRAEDTAVYYCAASEPYSDYDPSGMVYWGKGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCLASGRTVGRTAMGWFRQPPGKEREFVATISWAGGTTYYADFVKGRFTISRDNSKNTLYLQMNSLRAEDTAVYYCAASEPYSDYDPSGMVYWGKGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 297 - protein, 893 aa, Artificial Sequence
  Synthetic construct - Pro679 - aTrop2 hVIB578 sdAb - aCD3 Vh (2B2) - NCL-8 - aCD3Vl (2B2) - aTrop2 hVIB578 sdAb - MMP9-15 - aCD3Vli - NCL-8 - aCD3Vhi - aHSA (10GE) - His6
QVQLLESGGGLVQPGGSLRLSCAASGRTFGRAAMGWFRQPPGKEREFAATISWSGSNTYYADFVKGRFTISRDNSKNTVYLQMNSLRAEDTAVYYCAASEPYSDYDPSGMVYWGKGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFGRAAMGWFRQPPGKEREFAATISWSGSNTYYADFVKGRFTISRDNSKNTVYLQMNSLRAEDTAVYYCAASEPYSDYDPSGMVYWGKGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 298 - protein, 897 aa, Artificial Sequence
  Synthetic construct - Pro808 - aTROP2 hVIB609 sdAb - aCD3 Vh (2B2) - NCL-8 - aCD3Vl (2B2) - aTROP2 hVIB609 sdAb - MMP9-15 - aCD3Vli -NCL-8 - aCD3Vhi - aHSA (10GE) - His6
QVQLLESGGGLVQPGGSLRLSCALSGLTFNTYPMAWFRQPPGQEREFVADMSWSGTNTYYADSVKGRFTISRDNSKNTLYLQMNSLRAEDTAVYYCAAGWPYSGTGRSTTDYTYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCALSGLTFNTYPMAWFRQPPGQEREFVADMSWSGTNTYYADSVKGRFTISRDNSKNTLYLQMNSLRAEDTAVYYCAAGWPYSGTGRSTTDYTYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 299 - protein, 899 aa, Artificial Sequence
  Synthetic construct - Pro819 - aTROP2 hVIB619 sdAb - aCD3 Vh (2B2) - NCL-8 - aCD3Vl (2B2) - aTROP2 hVIB619 sdAb - MMP9-15 - aCD3Vli -NCL-8 - aCD3Vhi - aHSA (10GE) - His6
QVQLLESGGGLVQPGGSLRLSCAASGRSFSRYGMGWLRQAPGKERELVASISWSGHSTYYADSVKGRFTISRDNSKNTLYLQMNSLRAEDTAVYYCAAESLPYESGSPRLTDFASWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRSFSRYGMGWLRQAPGKERELVASISWSGHSTYYADSVKGRFTISRDNSKNTLYLQMNSLRAEDTAVYYCAAESLPYESGSPRLTDFASWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 300 - protein, 905 aa, Artificial Sequence
  Synthetic construct - Pro681 - aTrop2 hVIB557 sdAb - aCD3 Vh (2B2) - NCL-8 - aCD3Vl (2B2) - aTrop2 hVIB557 sdAb - NCL-16 - aCD3Vli - NCL-8 - aCD3Vhi - aHSA (10GE) - His6
QVQLLESGGGLVQPGGSLRLSCAASGRTFSSQSMGWFRQAPGKEREFVSAISWTGANPTYADSVKGRFTISRDNSKNTLYLQMNSLRAEDTAVYYCAADTSGGSYYYERATAETSYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFSSQSMGWFRQAPGKEREFVSAISWTGANPTYADSVKGRFTISRDNSKNTLYLQMNSLRAEDTAVYYCAADTSGGSYYYERATAETSYDYWGQGTLVTVSSGGGGSGGGGSGGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 301 - protein, 896 aa, Artificial Sequence
  Synthetic construct - Pro621 - aB7H3 hF7 sdAb - aCD3 Vh (2B2) - NCL-8 - aCD3Vl (2B2) - aB7H3 hF7 sdAb - CathS-16 - aCD3Vli - NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSARLQSAAPGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 302 - protein, 892 aa, Artificial Sequence
  Synthetic construct - Pro622 - aB7H3 hF12 sdAb - aCD3 Vh (2B2) - NCL-8 - aCD3Vl (2B2) - aB7H3 hF12 sdAb - CathS-16 - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSARLQSAAPGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 303 - protein, 897 aa, Artificial Sequence
  Synthetic construct - Pro640 - aB7H3 hF7 sdAb - aCD3 Vh (2B2) - NCL-8 - aCD3Vl (2B2) - aB7H3 hF7 sdAb - MMP9v - aCD3Vli - NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 304 - protein, 893 aa, Artificial Sequence
  Synthetic construct - Pro641 - aB7H3 hF12 sdAb - aCD3 Vh (2B2) - NCL-8 - aCD3Vl (2B2) - aB7H3 hF12 sdAb - MMP9v - aCD3Vli - NCL-8 - aCD3Vhi - aHSA (10GE) - His6
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 305 - protein, 895 aa, Artificial Sequence
  Synthetic construct - Pro642 - aB7H3 hF7 sdAb - aCD3 Vh (2B2) - NCL-8 - aCD3Vl (2B2) - aB7H3 hF7 sdAb - MMP9v - aCD3Vli2 - NCL-8 - aCD3Vhi2 - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGSGGPGPAGMHGLPGGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 306 - protein, 891 aa, Artificial Sequence
  Synthetic construct - Pro643 - aB7H3 hF12 sdAb - aCD3 Vh (2B2) - NCL-8 - aCD3Vl (2B2) - aB7H3 hF12 sdAb - MMP9v - aCD3Vli2 - NCL-8 - aCD3Vhi2 - aHSA (10GE) - His6
QVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCEASPRTFSTYSMAWFRQAPGKERSFVAAINWSGGNTSYADSVKGRFTISRDNSKNTLYLQMNSLRAEDTAVYYCAAGGVLAHHNYEYDYWGQGTLVTVSSGSGGPGPAGMHGLPGGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 307 - protein, 895 aa, Artificial Sequence
  Synthetic construct - Pro744  - aB7H3 hF7 sdAb - aCD3 Vh (2B2) - NCL-8 - aCD3Vl (2B2) - aB7H3 hF7 sdAb - MMP9-15 (K->E) - aCD3Vli -NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMEGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 308 - protein, 895 aa, Artificial Sequence
  Synthetic construct - Pro746  - haB7H3 F7 sdAb - aCD3 Vh (2B2) - NCL-8 - aCD3Vl (2B2) - haB7H3 F7 sdAb - MMP9-15 (M->P) - aCD3Vli -NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGPKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 309 - protein, 877 aa, Artificial Sequence
  Synthetic construct - Pro638 - aFOLR1 h77-2 sdAb - aCD3 Vh (2B2) - NCL-8 - aCD3Vl (2B2) - aFOLR1 h77-2 sdAb - MMP9v - aCD3Vli - NCL-8 - aCD3Vhi - aHSA (10GE) - His6
QVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGFTVSNSVMAWYRQTPGNEREFVAIINSIGITNYADSVKGRFTISRDNSKNTLYLQMNSLRAEDTAVYVCNRNFDRIYWGQGTLVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 310 - protein, 875 aa, Artificial Sequence
  Synthetic construct - Pro639  - aFOLR1 h59.3 sdAb - aCD3 Vh (2B2) - NCL-8 - aCD3Vl (2B2) - aFOLR1 h59.3 sdAb - MMP9v - aCD3Vli - NCL-8 - aCD3Vhi - aHSA (10GE) - His6
QVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSGSGGPGPAGMHGLPGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 311 - protein, 897 aa, Artificial Sequence; identical to SEQ ID NO: 248
  Synthetic construct - Pro396 - aEGFR sdAb - aCD3 Vh (2B2) - NCL-8 - aCD3Vl (2B2) - aEGFR sdAb - MMP9v-16 - aCD3Vli - NCL-8 - aCD3Vhi - aHSA (10GE) - His6

SEQ ID NO: 312 - protein, 893 aa, Artificial Sequence
  Synthetic construct - Pro476 - aEGFR sdAb - aCD3 Vh (2B2) - NCL-8 - aCD3Vl (2B2) - aEGFR sdAb - MMP9-15 - aCD3Vli2 - NCL-8 - aCD3Vhi2 - aHSA (10GE) - His6
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGGTKDDAPGTPARFSGSLLGGKAALTLSGVQPEDEAEYYCVLWYSNRWVFGGGTKLTVLGGGSGGGSEVQLVESGGGLVQPGGSLKLSCAASGFTFNKHAMNWVRQAPGKGLEWVARIRSKYNNYATAYADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 313 - protein, 896 aa, Artificial Sequence
  Synthetic construct - Pro706 - aEGFR sdAb - aCD3 Vh (2B2) - NCL-8 - aCD3Vl (2B2) - aEGFR sdAb - uPA - aCD3Vli - NCL-8 - aCD3Vhi - aHSA (10GE) - His6
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSHTGRSAYFGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 314 - protein, 895 aa, Artificial Sequence
  Synthetic construct - Pro709 - aEGFR sdAb - aCD3 Vh (2B2) - NCL-8 - aCD3Vl (2B2) - aEGFR sdAb - MMP9-15 - aCD3Vli - NCL-8 - aCD3Vhi - aHSA (10GE) - His6
EVQLVESGGGVVRPGGSLRLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSEVQLVESGGGVVRPGGSLRLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 315 - protein, 885 aa, Artificial Sequence; identical to SEQ ID NO: 243
  Synthetic construct - Pro470 - aFOLR1 h77.2 sdAb - aCD3 Vh (2B2) - NCL-8 - aCD3Vl (2B2) - aEGFR sdAb - MMP9-15 - aCD3Vli - NCL-8 - aCD3Vhi - aHSA (10GE) - His6

SEQ ID NO: 316 - protein, 885 aa, Artificial Sequence; identical to SEQ ID NO: 244
  Synthetic construct - Pro471  - aEGFR sdAb - aCD3 Vh (2B2) - NCL-8 - aCD3Vl (2B2) - aFOLR1 h77.2 sdAb - MMP9-15 - aCD3Vli - NCL-8 - aCD3Vhi - aHSA (10GE) - His6

SEQ ID NO: 317 - protein, 884 aa, Artificial Sequence
  Synthetic construct - Pro551 - EGFR sdAb - aCD3 Vh (2B2) - NCL-8 - aCD3Vl (2B2) - aFOLR1 h59.3 sdAb - MMP9-16 - aCD3Vli - NCL-8 - aCD3Vhi - aHSA (10GE) - His6
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 318 - protein, 884 aa, Artificial Sequence
  Synthetic construct - Pro552 - aFOLR1 h59.3 sdAb - aCD3 Vh (2B2) - NCL-8 - aCD3Vl (2B2) - EGFR sdAb - MMP9-15 - aCD3Vli - NCL-8 - aCD3Vhi - aHSA (10GE) - His6
QVQLVESGGGLVQPGGSLRLSCAAPGNTFSISAMGWYRQAPGKQREWVAVTHSDYSTNYADSVKGRFTISRDNSKNTLYLQMNSLRAEDTAVYYCKHYGIDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 319 - protein, 897 aa, Artificial Sequence
  Synthetic construct - Pro623 - aEGFR sdAb - aCD3 Vh (2B2) - NCL-8 - aCD3Vl (2B2) - acEpCAM hVIB664 sdAb - MMP9-15 - aCD3Vli - NCL-8 - aCD3Vhi - aHSA (10GE) - His6
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 320 - protein, 897 aa, Artificial Sequence
  Synthetic construct - Pro624 - aEGFR sdAb - aCD3 Vh (2B2) - NCL-8 - aCD3Vl (2B2) - acEpCAM hVIB665 sdAb - MMP9-15 - aCD3Vli - NCL-8 - aCD3Vhi - aHSA (10GE) - His6
QVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 321 - protein, 897 aa, Artificial Sequence
  Synthetic construct - Pro698 - acEpCAM hVIB665 sdAb - aCD3 Vh (2B2) - NCL-8 - aCD3Vl (2B2) - aEGFR sdAb - MMP9-15 - aCD3Vli - NCL-8 - aCD3Vhi - aHSA (10GE) - His6
QVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLVESGGGVVRPGGSLTLSCAASGRTSRSYGMGWFRQAPGKEREFVSGISWRGDSTGYADSVKGRFTISRDNAKNSLYLQMNSLRAEDTALYYCAAAAGSAWYGTLYEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 322 - protein, 897 aa, Artificial Sequence
  Synthetic construct - Pro655 - aB7H3 hF7 sdAb - aCD3 Vh (2B2) - NCL-8 - aCD3Vl (2B2) - acEpCAM hVIB664 sdAb - MMP9-15 - aCD3Vli - NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 323 - protein, 897 aa, Artificial Sequence
  Synthetic construct - Pro656 - aB7H3 hF7 sdAb - aCD3 Vh (2B2) - NCL-8 - aCD3Vl (2B2) - acEpCAM hVIB665 sdAb - MMP9-15 - aCD3Vli - NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 324 - protein, 897 aa, Artificial Sequence
  Synthetic construct - Pro657 - acEpCAM hVIB664 sdAb - aCD3 Vh (2B2) - NCL-8 - aCD3Vl (2B2) - haB7H3 F7 sdAb - MMP9-15 - aCD3Vli - NCL-8 - aCD3Vhi - aHSA (10GE) - His6
QVQLLESGGGLVQPGGSLRLSCAASGRTLDNYDMGWFRQGPGKEREFVAAISWSGGSTDYAYSVKGRFTISRDNSKNTLYLQMNSLRAEDTAVYYCAADLRFTGGDTMTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 325 - protein, 897 aa, Artificial Sequence
  Synthetic construct - Pro658 - acEpCAM hVIB665 sdAb - aCD3 Vh (2B2) - NCL-8 - aCD3Vl (2B2) - haB7H3 F7 sdAb - MMP9-15 - aCD3Vli - NCL-8 - aCD3Vhi - aHSA (10GE) - His6
QVQLLESGGGLVQPGGSLRLSCAASGRTFSDYDMGWFRQGPGKEREFVAAISWSGGHTNYADSVKGRFTISRDNSKNTLYLQMNSLRAEDTAVYYCAADLRFTGGDTTTPETYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 326 - protein, 885 aa, Artificial Sequence
  Synthetic construct - Pro516 - aCA9 hVIB456 sdAb - aCD3 Vh (2B2) - NCL-8 - aCD3Vl (2B2) - aCA9 hVIB456 sdAb - MMP9-15 - aCD3Vli - NCL-8 - aCD3Vhi - aHSA (10GE) - His6
QVQLVESGGGLVQPGGSLRLSCAASGSALIINAMGWYRQAPGKQRELVATVTRSGRTNYADSVKGRFTISRDNSKNTLYLQMNSLRAEDTAVYYCNVALWIADGEYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGSALIINAMGWYRQAPGKQRELVATVTRSGRTNYADSVKGRFTISRDNSKNTLYLQMNSLRAEDTAVYYCNVALWIADGEYDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 327 - protein, 879 aa, Artificial Sequence
  Synthetic construct - Pro517 - aCA9 hVIB476 sdAb - aCD3 Vh (2B2) - NCL-8 - aCD3Vl (2B2) - aCA9 hVIB476 sdAb - MMP9-15 - aCD3Vli - NCL-8 - aCD3Vhi - aHSA (10GE) - His6
QVQLVESGGGLVQPGGSLRLSCAASGNIFIINVMGWYRQAPGKQRELVATITNGGRTHYADSVKGRFTISRDNSKNTLYLQMNSLRAEDTAVYYCNANHIELGDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGNIFIINVMGWYRQAPGKQRELVATITNGGRTHYADSVKGRFTISRDNSKNTLYLQMNSLRAEDTAVYYCNANHIELGDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 328 - protein, 877 aa, Artificial Sequence
  Synthetic construct - Pro518 - aCA9 hVIB407 sdAb - aCD3 Vh (2B2) - NCL-8 - aCD3Vl (2B2) - aCA9 hVIB407 sdAb - MMP9-15 - aCD3Vli - NCL-8 - aCD3Vhi - aHSA (10GE) - His6
QVQLVESGGGLVQPGGSLRLSCTASGIIFSVYDMGWYRQTPGKQREFVARITAGGGTYLTDSVKGRFTISRDNSKNTLYLQMNSLRAEDTGVYYCNAAWIGDDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCTASGIIFSVYDMGWYRQTPGKQREFVARITAGGGTYLTDSVKGRFTISRDNSKNTLYLQMNSLRAEDTGVYYCNAAWIGDDYWGQGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 329 - protein, 877 aa, Artificial Sequence
  Synthetic construct - Pro519 - aCA9 hVIB445 sdAb - aCD3 Vh (2B2) - NCL-8 - aCD3Vl (2B2) - aCA9 hVIB445 sdAb - MMP9-15 - aCD3Vli - NCL-8 - aCD3Vhi - aHSA (10GE) - His6
QVQLVESGGGLVKPGGSLRLSCAASGITFNLHAMRWYRRAPGKQRELVAYISARDWTNYADSVKGRFTISRDNAKNSLYLQMNSLRAEDTAVYYCNTDLVGEDYWGRGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVKPGGSLRLSCAASGITFNLHAMRWYRRAPGKQRELVAYISARDWTNYADSVKGRFTISRDNAKNSLYLQMNSLRAEDTAVYYCNTDLVGEDYWGRGTLVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 330 - protein, 880 aa, Artificial Sequence
  Synthetic construct - Pro513 - aCA9 hVIB476 sdAb - aCD3 Vh (2B2) - NCL-8 - aCD3Vl (2B2) - aCA9 hVIB476 sdAb - NCL-16 - aCD3Vli - NCL-8 - aCD3Vhi - aHSA (10GE) - His6
QVQLVESGGGLVQPGGSLRLSCAASGNIFIINVMGWYRQAPGKQRELVATITNGGRTHYADSVKGRFTISRDNSKNTLYLQMNSLRAEDTAVYYCNANHIELGDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLVESGGGLVQPGGSLRLSCAASGNIFIINVMGWYRQAPGKQRELVATITNGGRTHYADSVKGRFTISRDNSKNTLYLQMNSLRAEDTAVYYCNANHIELGDYWGQGTLVTVSSGGGSGGGSGGGSGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 331 - protein, 895 aa, Artificial Sequence
  Synthetic construct - Pro186 - aEGFR sdAb - aCD3 Vh (2B2) - NCL-8 - aCD3Vl (2B2) - aEGFR sdAb - MMP9-15 - aCD3Vli -NCL-8 - aCD3Vhi - aHSA (10GE) - His6
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 332 - protein, 895 aa, Artificial Sequence
  Synthetic construct - Pro214 - aEGFR sdAb - aCD3 Vh (2B2) - NCL-8 - aCD3Vl (2B2) - aEGFR sdAb - NCL-15 - aCD3Vli - NCL-8 - aCD3Vhi - aHSA (10GE) - His6
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 333 - protein, 895 aa, Artificial Sequence; identical to SEQ ID NO: 235
  Synthetic construct - Pro225 - aB7H3 hF7 sdAb - aCD3 Vh (2B2) - NCL-8 - aCD3Vl (2B2) - aB7H3 hF7 sdAb - MMP9-15 - aCD3Vli -NCL-8 - aCD3Vhi - aHSA (10GE) - His6

SEQ ID NO: 334 - protein, 895 aa, Artificial Sequence
  Synthetic construct - Pro295 - aB7H3 hF7 sdAb - aCD3 Vh (2B2) - NCL-8 - aCD3Vl (2B2) - aB7H3 hF7 sdAb - NCL-15 - aCD3Vli - NCL-8 - aCD3Vhi - aHSA (10GE) - His6
QVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVQLQESGGGLVQPGGSLRLSCAPSRRTFHTYHMGWFRQAPGKEREFVAVINWSGGSTVYADSVKGRFTISRDNSKNTLYLQMNSLRAEDTAVYYCAAGGATTQRATEASYDYWGQGTLVTVSSGGGGSGGGGSGGGGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSEVQLVESGGGLVQPGNSLRLSCAASGFTFSKFGMSWVRQAPGKGLEWVSSISGSGRDTLYAESVKGRFTISRDNAKTTLYLQMNSLRPEDTAVYYCTIGGSLSVSSQGTLVTVSSHHHHHH

SEQ ID NO: 335 - protein, 1359 aa, Artificial Sequence
  Synthetic construct - Pro 817 - aEGFR sdAb - aCD3 Vh (2B2) - NCL-8 - aCD3Vl (2B2) - aEGFR sdAb - MMP9-15 - aCD3Vli -NCL-8 - aCD3Vhi - HAS
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGSGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSSGGPGPAGMKGLPGSQTVVTQEPSLTVSPGGTVTLTCGSSTGAVTSGNYPNWVQQKPGQAPRGLIGDYKDDDDKGTPARFSGSLLGGKAALTLSGVQPEDEAEYYCVLWYSNRWVFGGGTKLTVLGGGSGGGSEVQLVESGGGLVQPGGSLKLSCAASGFTFNKYAMNWVRQAPGKGLEWVARIRSKYDYKDDDDKADSVKDRFTISRDDSKNTAYLQMNNLKTEDTAVYYCVRHGNFGNSYISYWAYWGQGTLVTVSSGGGGSGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYKTTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASRAALGL

What is claimed is:

1. A single domain antigen binding domain (sdABD) that binds human Trop2, wherein the sdABD comprises:
   (i) a complementarity-determining region 1 (CDR1) comprising the amino acid sequence of SEQ ID NO: 78, a complementarity-determining region 2 (CDR2) comprising the amino acid sequence of SEQ ID NO: 79, and a complementarity-determining region 3 (CDR3) comprising the amino acid sequence of SEQ ID NO: 80;
   (ii) a CDR1 comprising the amino acid sequence of SEQ ID NO: 82, a CDR2 comprising the amino acid sequence of SEQ ID NO: 83, and a CDR3 comprising the amino acid sequence of SEQ ID NO: 84;
   (iii) a CDR1 comprising the amino acid sequence of SEQ ID NO: 86, a CDR2 comprising the amino acid sequence of SEQ ID NO: 87, and a CDR3 comprising the amino acid sequence of SEQ ID NO: 88;
   (iv) a CDR1 comprising the amino acid sequence of SEQ ID NO: 90, a CDR2 comprising the amino acid sequence of SEQ ID NO: 91, and a CDR3 comprising the amino acid sequence of SEQ ID NO: 92;
   (v) a CDR1 comprising the amino acid sequence of SEQ ID NO: 94, a CDR2 comprising the amino acid sequence of SEQ ID NO: 95, and a CDR3 comprising the amino acid sequence of SEQ ID NO: 96; or
   (vi) a CDR1 comprising the amino acid sequence of SEQ ID NO: 98, a CDR2 comprising the amino acid sequence of SEQ ID NO: 99, and a CDR3 comprising the amino acid sequence of SEQ ID NO: 100.

2. The sdABD of claim 1, wherein the sdABD comprises a CDR1 comprising the amino acid sequence of SEQ ID NO: 78, a CDR2 comprising the amino acid sequence of SEQ ID NO: 79, and a CDR3 comprising the amino acid sequence of SEQ ID NO: 80.

3. The sdABD of claim 2, wherein the sdABD comprises the amino acid sequence of SEQ ID No: 77.

4. The sdABD of claim 1, wherein the sdABD comprises a CDR1 comprising the amino acid sequence of SEQ ID NO: 82, a CDR2 comprising the amino acid sequence of SEQ ID NO: 83, and a CDR3 comprising the amino acid sequence of SEQ ID NO: 84.

5. The sdABD of claim 4, wherein the sdABD comprises the amino acid sequence of SEQ ID No: 81.

6. The sdABD of claim 1, wherein the sdABD comprises a CDR1 comprising the amino acid sequence of SEQ ID NO: 86, a CDR2 comprising the amino acid sequence of SEQ ID NO: 87, and a CDR3 comprising the amino acid sequence of SEQ ID NO: 88.

7. The sdABD of claim 6, wherein the sdABD comprises the amino acid sequence of SEQ ID No: 85.

8. The sdABD of claim 1, wherein the sdABD comprises a CDR1 comprising the amino acid sequence of SEQ ID NO: 90, a CDR2 comprising the amino acid sequence of SEQ ID NO: 91, and a CDR3 comprising the amino acid sequence of SEQ ID NO: 92.

9. The sdABD of claim 8, wherein the sdABD comprises the amino acid sequence of SEQ ID No: 89.

10. The sdABD of claim 1, wherein the sdABD comprises a CDR1 comprising the amino acid sequence of SEQ ID NO: 94, a CDR2 comprising the amino acid sequence of SEQ ID NO: 95, and a CDR3 comprising the amino acid sequence of SEQ ID NO: 96.

11. The sdABD of claim 10, wherein the sdABD comprises the amino acid sequence of SEQ ID No: 93.

12. The sdABD of claim 1, wherein the sdABD comprises a CDR1 comprising the amino acid sequence of SEQ ID NO: 98, a CDR2 comprising the amino acid sequence of SEQ ID NO: 99, and a CDR3 comprising the amino acid sequence of SEQ ID NO: 100.

13. The sdABD of claim 12, wherein the sdABD comprises the amino acid sequence of SEQ ID No: 97.

14. A nucleic acid molecule comprising a nucleotide sequence encoding the sdABD of claim 1.

15. The nucleic acid molecule of claim 14, wherein the nucleic acid molecule is a vector.

16. The nucleic acid molecule of claim 15, wherein the vector is an expression vector.

17. A host cell comprising the nucleic acid molecule of claim 16.

18. The host cell of claim 17, wherein the host cell is a mammalian cell.

19. A method comprising culturing the host cell of claim 17 under conditions that allow expression of the sdABD.

20. The method of claim 19, further comprising isolating the sdABD.

* * * * *